(12) United States Patent
Parks et al.

(10) Patent No.: US 10,358,654 B2
(45) Date of Patent: Jul. 23, 2019

(54) PESTICIDAL GENES AND METHODS OF USE

(71) Applicant: AgBiome, Inc., Research Triangle Park, NC (US)

(72) Inventors: Jessica Parks, Raleigh, NC (US); Kira Bulazel Roberts, Bahama, NC (US); Rebecca E. Thayer, Morrisville, NC (US)

(73) Assignee: AGBIOME, INC., Research Triangle Park, NC (US)

( * ) Notice: Subject to any disclaimer, the term of this patent is extended or adjusted under 35 U.S.C. 154(b) by 0 days.

(21) Appl. No.: 15/530,267

(22) Filed: Dec. 16, 2016

(65) Prior Publication Data

US 2017/0175134 A1  Jun. 22, 2017

Related U.S. Application Data

(60) Provisional application No. 62/270,742, filed on Dec. 22, 2015, provisional application No. 62/412,619, filed on Oct. 25, 2016.

(51) Int. Cl.
| | | |
|---|---|---|
| *C12N 15/82* | (2006.01) | |
| *C07K 14/195* | (2006.01) | |
| *C07K 14/32* | (2006.01) | |
| *A01N 63/02* | (2006.01) | |
| *C07K 14/325* | (2006.01) | |
| *A01N 37/46* | (2006.01) | |

(52) U.S. Cl.
CPC ......... *C12N 15/8286* (2013.01); *A01N 37/46* (2013.01); *A01N 63/02* (2013.01); *C07K 14/195* (2013.01); *C07K 14/32* (2013.01); *C07K 14/325* (2013.01); *C12N 15/8261* (2013.01); *C12N 15/8285* (2013.01); *Y02A 40/146* (2018.01); *Y02A 40/162* (2018.01); *Y02A 40/164* (2018.01)

(58) Field of Classification Search
CPC ............ C12N 15/8285; C12N 15/8286; C07K 14/195; A01N 63/02; A01N 25/006
See application file for complete search history.

(56) References Cited

U.S. PATENT DOCUMENTS

| | | | |
|---|---|---|---|
| 5,596,071 A * | 1/1997 | Payne | A01N 63/00 435/252.5 |
| 5,616,495 A | 4/1997 | Payne et al. | |
| 5,824,792 A | 10/1998 | Payne et al. | |
| 6,077,937 A | 6/2000 | Payne et al. | |
| 9,567,381 B2 | 2/2017 | Kennedy et al. | |
| 2014/0283208 A1 | 9/2014 | Abad et al. | |

FOREIGN PATENT DOCUMENTS

| WO | 2010/027793 A1 | 3/2010 |
|---|---|---|
| WO | 2010/027799 A1 | 3/2010 |

OTHER PUBLICATIONS

Argôlo-Filho, Ronaldo Costa, and Leandro Lopes Loguercio. "Bacillus thuringiensis is an environmental pathogen and host-specificity has developed as an adaptation to human-generated ecological niches." Insects 5.1 (2013): 62-91. (Year: 2013).*
Heckel, David G. "Learning the ABCs of Bt: ABC transporters and insect resistance to Bacillus thuringiensis provide clues to a crucial step in toxin mode of action." Pesticide Biochemistry and Physiology 104.2 (2012): 103-110. (Year: 2012).*
Guo, Haiwei H., Juno Choe, and Lawrence A. Loeb. "Protein tolerance to random amino acid change." Proceedings of the National Academy of Sciences 101.25 (2004): 9205-9210. (Year: 2004).*
International Preliminary Report on Patentability of PCT/US2016/067146 dated Jul. 5, 2018, 12 pages.
International Search Report and Written Opinion of PCT/US2016/067146 dated Aug. 9, 2017, 16 pages.
Invitation to Pay Additional Fees of PCT/US2016/067146 dated May 19, 2017, 11 pages.
GenBank Accession No. AAA68598.1, "delta endotoxin, partial [Bacillus thuringiensis]"; Jun. 21, 1995; via internet at https://www.ncbi.nlm.nih.gov/protein/862637/.
UniProtKB/Swiss-Prot (GenBank) Accession No. Q45712.1, "RecName: Full=Pesticidal crystal protein Cry5Ba; AltName: Full=140 kDa crystal protein; AltName: Full=Crystaline entomocidal protoxin; AltName: Full=Insecticidal delta-endotoxin CryVB(a)"; Jul. 18, 2018, via internet https://www.ncbi.nlm.nih.gov/protein/Q45712.1.
GenBank Accession No. AAB46298.1, "Sequence 8 from U.S. Pat. No. 5,596,071"; Feb. 7, 1997, via internet at https://www.ncbi.nlm.nih.gov/protein/AAB46298.1.
GenBank Accession No. AAB55098.1, "Sequence 8 from U.S. Pat. No. 5,616,495"; May 14, 1997, via internet at https://www.ncbi.nlm.nih.gov/protein/AAB55098.1.

(Continued)

*Primary Examiner* — Weihua Fan
(74) *Attorney, Agent, or Firm* — Kilpatrick Townsend & Stockton LLP

(57) ABSTRACT

Compositions having pesticidal activity and methods for their use are provided. Compositions include isolated and recombinant polypeptides having pesticidal activity, recombinant and synthetic nucleic acid molecules encoding the polypeptides, DNA constructs and vectors comprising the nucleic acid molecules, host cells comprising the vectors, and antibodies to the polypeptides. Polynucleotide sequences encoding the polypeptides can be used in DNA constructs or expression cassettes for transformation and expression in organisms of interest. The compositions and methods provided are useful for producing organisms with enhanced pest resistance or tolerance. Transgenic plants and seeds comprising a nucleotide sequence that encodes a pesticidal protein of the invention are also provided. Such plants are resistant to insects and other pests. Methods are provided for producing the various polypeptides disclosed herein, and for using those polypeptides for controlling or killing a pest. Methods and kits for detecting polypeptides of the invention in a sample are also included.

29 Claims, 9 Drawing Sheets
Specification includes a Sequence Listing.

(56) References Cited

OTHER PUBLICATIONS

GenBank Accession No. AAE12606.1, "Sequence 8 from U.S. Pat. No. 5,824,792"; Sep. 29, 1999, via internet at https://www.ncbi.nlm.nih.gov/protein/AAE12606.1.
GenBank Accession No. AAE44105.1, "Sequence 8 from U.S. Pat. No. 6,077,937"; Feb. 14, 2001, via internet at https://www.ncbi.nlm.nih.gov/protein/AAE44105.1.
GenBank Accession No. ATK48782.1, "Sequence 432 from U.S. Pat. No. 9,567,381"; Oct. 13, 2017, via internet at https://www.ncbi.nlm.nih.gov/protein/ATK48782.1.
GenBank Accession No. ABW88931.1, "Cry5B-like protein [Bacillus thuringiensis YBT-1518]"; Nov. 17, 2008, via internet at https://www.ncbi.nlm.nih.gov/protein/159137703/.
NCBI Reference Sequence: WP_023521141.1, "pesticidal crystal protein cry5Ba [Bacillus thuringiensis]"; Jan. 27, 2016, via internet at https://www.ncbi.nlm.nih.gov/protein/WP_023521141.1.
GenBank Accession No. AHA70031.1, "pesticidial crystal protein cry5Ba [Bacillus thuringiensis YBT-1518]"; Feb. 13, 2015, via internet at https://www.ncbi.nlm.nih.gov/protein/AHA70031.1.
GenBank Accession No. ATK48783.1, "Sequence 433 from U.S. Pat. No. 9,567,381"; Oct. 13, 2017, via internet at https://www.ncbi.nlm.nih.gov/protein/ATK48783.1.
GenBank Accession No. AFJ04417.1, "Cry5B-like delta endotoxin [Bacillus thuringiensis]"; May 8, 2012, via internet at https://www.ncbi.nlm.nih.gov/protein/AFJ04417.1.
GenBank Accession No. ATK48784.1, "Sequence 434 from U.S. Pat. No. 9,567,381"; Oct. 13, 2017, via internet at https://www.ncbi.nlm.nih.gov/protein/ATK48784.1.

\* cited by examiner

FIGURE 1

|  | b | m,b | s,b | s,m,b | s,m | s |
|---|---|---|---|---|---|---|
| 0-50% | . | . | . | . | +/- | +/- |
| 50-80% | . | . | . | +/- | +/- | +/- |
| 80-100% | +/- | +/- | +/- | +/- | + | + |

Increasing size phenotype →

Increasing mortality →

FIGURE 2

```
                                    20              40              60
                                     |               |               |
APG01037.1  ---------- ----------  -MPIQEKFSF SELSAVGSNP NSVREKFKER FGVLPDGIAV  39
APG01037.0  ---------- ----------   MPIQEKFSF SELSAVGSNP NSVREKFKER FGVLPDGIAV  40
APG01037.4  ---------- ----------  -MPIQEKFSF SELSAVGSNP NSVREKFKER FGVLPDGIAV  39
APG01037.5  ---------- ----------  -MPIQEKFSF SELSAVGSNP NSVREKFKER FGVLPDGIAV  39
APG01037.6  ---------- ----------  -MPIQEKFSF SELSAVGSNP NSVREKFKER FGVLPDGIAV  39
APG01037.7  ---------- ----------  -MPIQEKFSF SELSAVGSNP NSVREKFKER FGVLPDGIAV  39
APG01037.8  ---------- ----------  -MPIQEKFSF SELSAVGSNP NSVREKFKER FGVLPDGIAV  39
APG00556.0  MSFLVLSFRG IELLKNQRSV  MPIQEKFSF SELSAVGSNP NSVREKFKER FGILPDGIAV   60
APG00556.1  ---------- ----------  -MPIQEKFSF SELSAVGSNP NSVREKFKER FGILPDGIAV  39
APG00623.0  ---------- ----------  -MPIQEKFSF SELSAVGSNP NSIREKFKER FGVLPDGIAV  39

80              100             120
                            |               |               |
APG01037.1  NSETYYNAEK PAITEQYGHP CYKTLGEFTY QIGNGQPPSE AILGSNYAVN HGDEEASISL  99
APG01037.0  NSETYYNAEK PAITEQYGHP CYKTLGEFTY QIGNGQPPSE AILGSNYAVN HGDEEASISL 100
APG01037.4  NSETYYNAEK PAITEQYGHP CYKTLGEFTY QIGNGQPPSE AILGSNYAVN HGDEEASISL  99
APG01037.5  NSETYYNAEK PAITEQYGHP CYKTLGEFTY QIGNGQPPSE AILGSNYAVN HGDEEASISL  99
APG01037.6  NSETYYNAEK PAITEQYGHP CYKTLGEFTY QIGNGQPPSE AILGSNYAVN HGDEEASISL  99
APG01037.7  NSETYYNAEK PAITEQYGHP CYKTLGEFTY QIGNGQPPSE AILGSNYAVN HGDEEASISL  99
APG01037.8  NSETYYNAEK PAITEQYGHP CYKTLGEFTY QIGNGQPPSE AILGSNYAVN HGDEEASISL  99
APG00556.0  NSETYYDASK PAITEQYGHP CYKTLGEFTY QIGNGKPPSE AILGSNYAVN HGDEEASISL 120
APG00556.1  NSETYYDASK PAITEQYGHP CYKTLGEFTY QIGNGKPPSE AILGSNYAVN HGDEEASISL  99
APG00623.0  NSETYYDASK PAITEQYGHP CYKTLGEFTY QIGNGKPPSE AILGSNYAVN HGDEEASISL  99

140             160             180
                           |               |               |
APG01037.1  SVQGNWTETK TWSSQTTTGL TISSKFTLEG VFESGAEFSV STTVGESSST SISRSASSTV 159
APG01037.0  SVQGNWTETK TWSSQTTTGL TISSKFTLEG VFESGAEFSV STTVGESSST SISRSASSTV 160
APG01037.4  SVQGNWTETK TWSSQTTTGL TISSKFTLEG VFESGAEFSV STTVGESSTT SISRSASSTV 159
APG01037.5  SVQGNWTETK TWSSQTTTGL TISSKFTLEG VFESGAEFSV STTVGETSST SISRSASSTV 159
APG01037.6  SVQGNWTETK TWSSQTTTGL TISSKFTLEG VFESGAEFSV STTVGESKST SISRSASSTV 159
APG01037.7  SVQGNWTETK TWSSQTTTGL TISSKFTLEG VFESGAEFSV STTVGESSSE SISRSASSTV 159
APG01037.8  SVQGNWTETK TWSSQTTTGL TISSKFTLEG VFESGAEFSV STTVGESSST SESRSASSTV 159
APG00556.0  SVQGNWTETK TWSSETTTGL TISSKFTLEG VFESGAEFSV STTVGESSST SISRSASSTV 180
APG00556.1  SVQGNWTETK TWSSETTTGL TISSKFTLEG VFESGAEFSV STTVGESSST SISRSASSTV 159
APG00623.0  SVQGNWTETK TWSSQTTTGL TISSKFTLEG VFESGAEFSV STTVGESSST SISRSASSTV 159

200             220             240
                           |               |               |
APG01037.1  TVNVPPRSKK KISMVGTMKQ ETMNFQAPLS VQGSFGANFP RKVEDHYFWF LGADNVLNST 219
APG01037.0  TVNVPPRSKK KISMVGTMKQ ETMNFQAPLS VQGSFGANFP RKVEDHYFWF LGADNVLNST 220
APG01037.4  TVNVPPRSKK KISMVGTMKQ ETMNFQAPLS VQGSFGANFP RKVEDHYFWF LGADNVLNST 219
APG01037.5  TVNVPPRSKK KISMVGTMKQ ETMNFQAPLS VQGSFGANFP RKVEDHYFWF LGADNVLNST 219
APG01037.6  TVNVPPRSKK KISMVGTMKQ ETMNFQAPLS VQGSFGANFP RKVEDHYFWF LGADNVLNST 219
APG01037.7  TVNVPPRSKK KISMVGTMKQ ETMNFQAPLS VQGSFGANFP RKVEDHYFWF LGADNVLNST 219
APG01037.8  TVNVPPRSKK KISMVGTMKQ ETMNFQAPLS VQGSFGANFP RKVEDHYFWF LGADNVLNST 219
APG00556.0  IVIVPPRSKK KVSMVGTMKQ ETMNFQAPLS VQGSFGANFP RKVEDHYFWF LGADNVLNST 240
APG00556.1  TVIVPPRSKK KVSMVGTMKQ ETMNFQAPLS VQGSFGANFP RKVEDHYFWF LGADNVLNST 219
APG00623.0  TVNVPPRSKK KISMVGTMKQ ETMNFQAPLS VQGSFGANFP RKVEDHYFWF LGADNVLNST 219

260
                           |
APG01037.1  TGTLTGKIKN TAVFDVQTEV GAAEPLDAKT PV 251
APG01037.0  TGTLTGKIKN TAVFDVQTEV GAAEPLDAKT PV 252
APG01037.4  TGTLTGKIKN TAVFDVQTEV GAAEPLDAKT PV 251
APG01037.5  TGTLTGKIKN TAVFDVQTEV GAAEPLDAKT PV 251
APG01037.6  TGTLTGKIKN TAVFDVQTEV GAAEPLDAKT PV 251
APG01037.7  TGTLTGKIKN TAVFDVQTEV GAAEPLDAKT PV 251
APG01037.8  TGTLTGKIKN TAVFDVQTEV GAAEPLDAKT PV 251
APG00556.0  TGTLTGKIKN TAVFNVQTEV GAAEPLDAKT PV 272
APG00556.1  TGTLTGKIKN TAVFNVQTEV GAAEPLDAKT PV 251
APG00623.0  TGTLTGKIKN TAVFDVQTEV GAAEPLDAKT PV 251
```

FIGURE 8

Pairwise sequence comparison showing global percent identity relationship of each recited sequence.

| | APG01037.1 | APG01037.0 | APG01037.4 | APG01037.5 | APG01037.6 | APG01037.7 | APG01037.8 | APG00556.0 | APG00556.1 | APG00632.0 |
|---|---|---|---|---|---|---|---|---|---|---|
| APG01037.1 | | 99.60 | 99.60 | 99.60 | 99.60 | 99.60 | 99.60 | 88.60 | 95.02 | 98.41 |
| APG01037.0 | 99.60 | | 99.21 | 99.21 | 99.21 | 99.21 | 99.21 | 88.97 | 95.63 | 98.02 |
| APG01037.4 | 99.60 | 99.21 | | 99.20 | 99.20 | 99.20 | 99.20 | 88.24 | 95.62 | 98.01 |
| APG01037.5 | 99.60 | 99.21 | 99.20 | | 99.20 | 99.20 | 99.20 | 88.24 | 95.62 | 98.01 |
| APG01037.6 | 99.60 | 99.21 | 99.20 | 99.20 | | 99.20 | 99.20 | 88.24 | 95.62 | 98.01 |
| APG01037.7 | 99.60 | 99.21 | 99.20 | 99.20 | 99.20 | | 99.20 | 88.24 | 95.62 | 98.01 |
| APG01037.8 | 99.60 | 99.21 | 99.20 | 99.20 | 99.20 | 99.20 | | 88.60 | 96.02 | 98.01 |
| APG00556.0 | 88.60 | 88.97 | 88.24 | 88.24 | 88.24 | 88.24 | 88.60 | | 92.28 | 88.97 |
| APG00556.1 | 96.02 | 95.63 | 95.62 | 95.62 | 95.62 | 95.62 | 96.02 | 92.28 | | 96.41 |
| APG00632.0 | 98.41 | 98.02 | 98.01 | 98.01 | 98.01 | 98.01 | 98.01 | 88.97 | 96.41 | |

FIGURE 9

PESTICIDAL GENES AND METHODS OF USE

CROSS REFERENCE TO RELATED APPLICATION

This application claims the benefit of U.S. Provisional Application Ser. No. 62/270,742 filed Dec. 22, 2015 and U.S. Provisional Application Ser. No. 62/412,619 filed Oct. 25, 2016, the contents of these applications are herein incorporated by reference in their entirety.

FIELD OF THE INVENTION

The invention is drawn to methods and compositions for controlling pests, particularly plant pests.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named AgB024US-1029227_SeqList.txt, created on Dec. 16, 2016, and having a size of 1.18 MB. The sequence listing contained in this ASCII formatted document is part of the specification and is herein incorporated by reference in its entirety.

BACKGROUND

Pests, plant diseases, and weeds can be serious threats to crops. Losses due to pests and diseases have been estimated at 37% of the agricultural production worldwide, with 13% due to insects, bacteria and other organisms.

Toxins are virulence determinants that play an important role in microbial pathogenicity and/or evasion of the host immune response. Toxins from the gram-positive bacterium *Bacillus*, particularly *Bacillus thuringiensis*, have been used as insecticidal proteins. Current strategies use the genes expressing these toxins to produce transgenic crops. Transgenic crops expressing insecticidal protein toxins are used to combat crop damage from insects.

While the use of *Bacillus* toxins has been successful in controlling insects, resistance to Bt toxins has developed in some target pests in many parts of the world where such toxins have been used intensively. One way of solving this problem is sowing Bt crops with alternating rows of regular non Bt crops (refuge). An alternative method to avoid or slow down development of insect resistance is stacking insecticidal genes with different modes of action against insects in transgenic plants. The current strategy of using transgenic crops expressing insecticidal protein toxins is placing increasing emphasis on the discovery of novel toxins, beyond those already derived from the bacterium *Bacillus thuringiensis*. These toxins may prove useful as alternatives to those derived from *B. thuringiensis* for deployment in insect- and pest-resistant transgenic plants. Thus, new toxin proteins are needed.

BRIEF DESCRIPTION OF THE FIGURES

Figure 1:
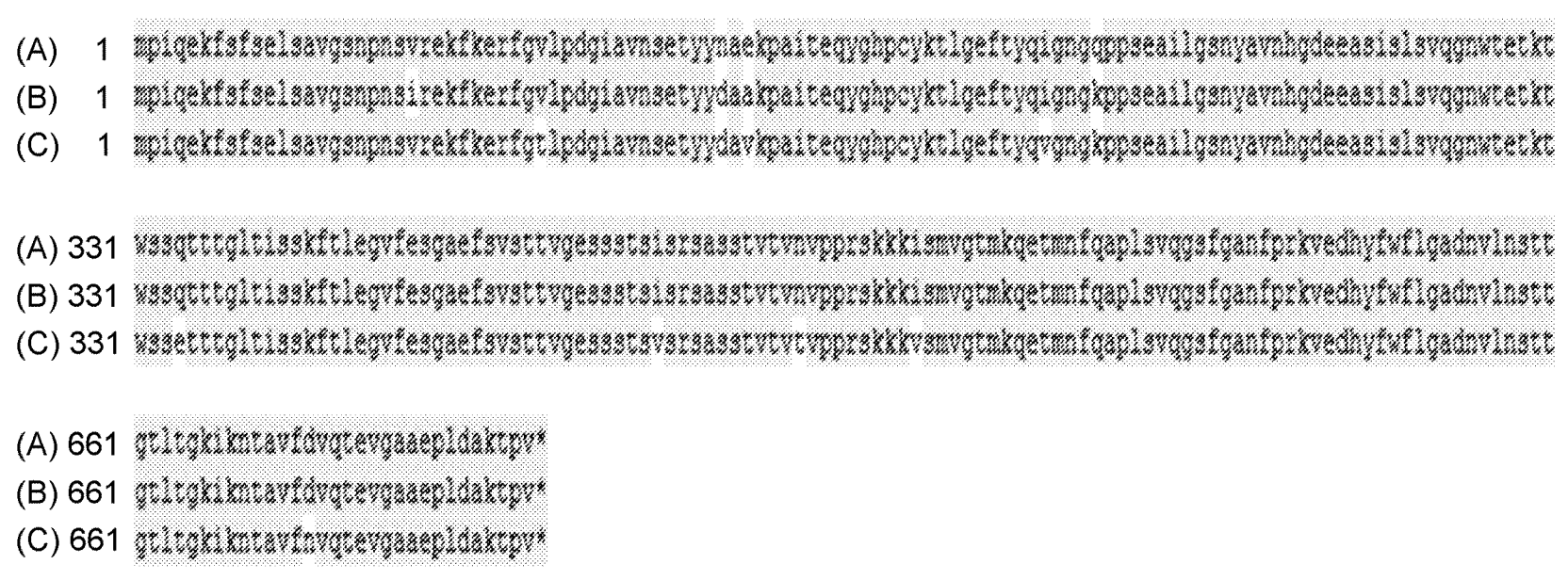

FIG. 1 provides an amino acid alignment of SEQ ID NO: 209, 207, and 206. Highlighted regions denote regions where the amino acids are the same between the three polypeptides.

FIG. 2 provides the assay scoring guidelines (size×mortality matrix) employed in the western corn rootworm bioassay. "S" indicates small in size, "m" indicates medium in size, and "b" indicated big in size.

FIG. 8 provides an alignment of SEQ ID NO: 209 against various active variants. The sequences present in the alignment are as follows: APG01037.1 (SEQ ID NO: 209); APG01037.0 (SEQ ID NO: 208); APG01037.4 (SEQ ID NO: 210); APG01037.5 (SEQ ID NO: 211); APG01037.6 (SEQ ID NO: 212); APG01037.7 (SEQ ID NO: 213); APG01037.8 (SEQ ID NO: 214); APG00556.0 (SEQ ID NO: 205); APG00556.1 (SEQ ID NO: 206); and APG00623.0 (SEQ ID NO: 207).

FIG. 9 provides the sequences identity relationships of various active variants of SEQ ID NO: 209.

SUMMARY

Figure 3:
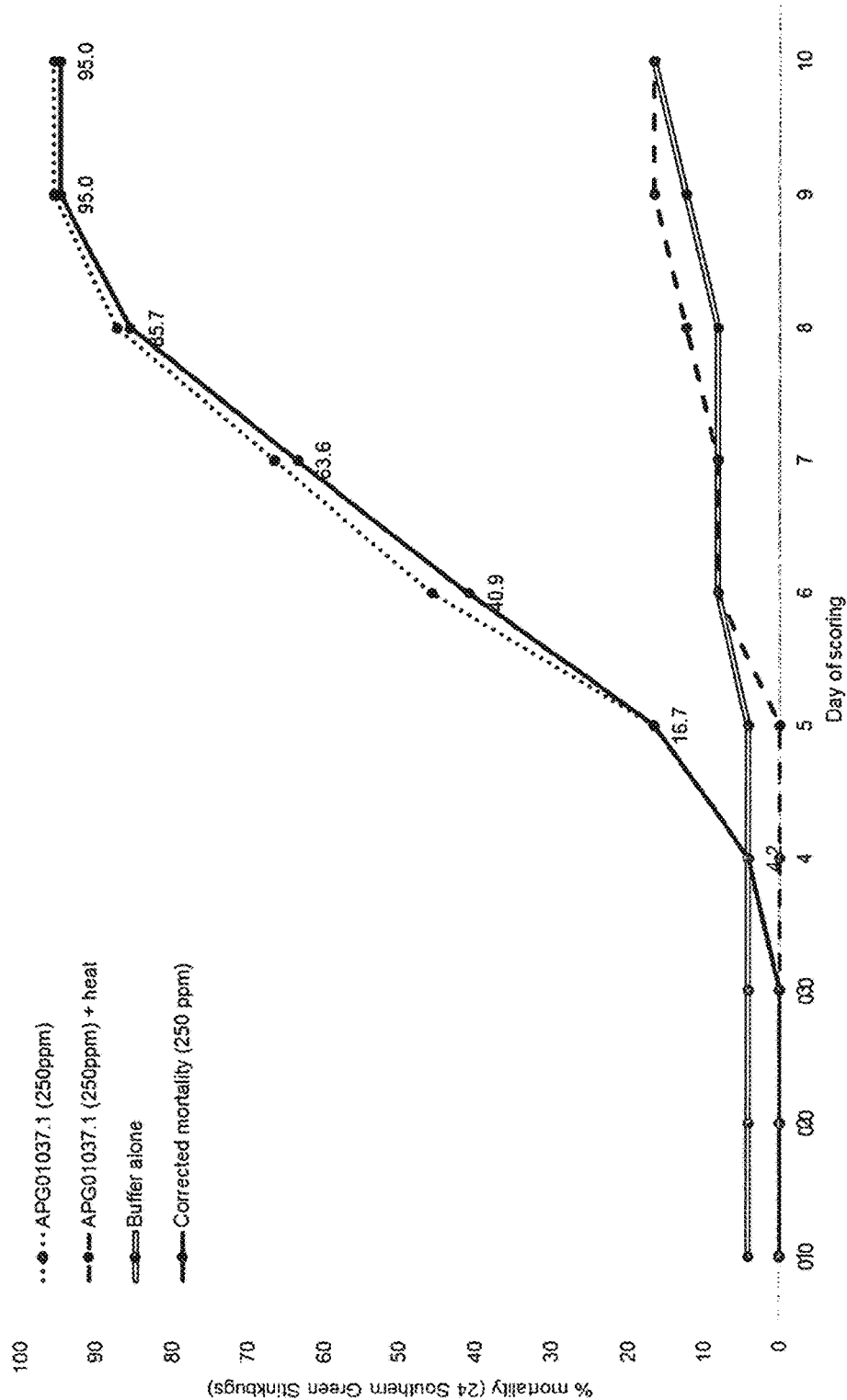
FIG. 3 provides the results of the time course assay of APG01037.1 (SEQ ID NO: 209) against SGSB.

Compositions having pesticidal activity and methods for their use are provided. Compositions include isolated and recombinant polypeptide sequences having pesticidal activity, recombinant and synthetic nucleic acid molecules encoding the pesticidal polypeptides, DNA constructs comprising the nucleic acid molecules, vectors comprising the nucleic acid molecules, host cells comprising the vectors, and antibodies to the pesticidal polypeptides. Nucleotide sequences encoding the polypeptides provided herein can be used in DNA constructs or expression cassettes for transformation and expression in organisms of interest, including microorganisms and plants.

The compositions and methods provided herein are useful for the production of organisms with enhanced pest resistance or tolerance. These organisms and compositions comprising the organisms are desirable for agricultural purposes. Transgenic plants and seeds comprising a nucleotide sequence that encodes a pesticidal protein of the invention are also provided. Such plants are resistant to insects and other pests.

Methods are provided for producing the various polypeptides disclosed herein, and for using those polypeptides for controlling or killing a pest. Methods and kits for detecting polypeptides of the invention in a sample are also included.

DETAILED DESCRIPTION OF THE INVENTION

The present inventions now will be described more fully hereinafter with reference to the accompanying drawings, in which some, but not all embodiments of the inventions are shown. Indeed, these inventions may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

I. Polynucleotides and Polypeptides

Compositions and method for conferring pesticidal activity to an organism are provided. The modified organism exhibits pesticidal resistance or tolerance. Recombinant pesticidal proteins, or polypeptides and fragments and variants thereof that retain pesticidal activity, are provided and include those set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218. The pesticidal proteins are biologically active (e.g., pesticidal) against pests including insects, fungi, nematodes, and the like. Nucleotides encoding the pesticidal polypeptides, including for example, SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218 or active fragments or variants thereof, can be used to produce transgenic organisms, such as plants and microorganisms. The pesticidal proteins are biologically active (for example, are pesticidal) against pests including insects, fungi, nematodes, and the like. Polynucleotides encoding the pesticidal polypeptides, including for example, SEQ ID NOS: 1-218 or active fragments or variants thereof, can be used to produce transgenic organisms, such as plants and microorganisms. The transformed organisms are characterized by genomes that comprise at least one stably incorporated DNA construct comprising a coding sequence for a pesticidal protein disclosed herein. In some embodiments, the coding sequence is operably linked to a promoter that drives expression of the encoded pesticidal polypeptide. Accordingly, transformed microorganisms, plant cells, plant tissues, plants, seeds, and plant parts are provided. A summary of various polypeptides, active variants and fragments thereof, and polynucleotides encoding the same are set forth below in Table 1. As noted in Table 1, various forms of polypeptides are provided. Full length pesticidal polypeptides, as well as, modified versions of the original full-length sequence (i.e., variants) are provided. Table 1 further denotes "CryBP1" sequences. Such sequences (SEQ ID NOS: 103 and 178) comprise accessory polypeptides that can be associated with some of the toxin genes. In such instances, the CryBP1 sequences can be used alone or in combination with any of the pesticidal polypeptides provided herein. Table 1 further provides Split-Cry C-terminus polypeptides (SEQ ID NO: 30, 112, 135, 193, or 203). Such sequence comprise the sequence of a downstream protein that has homology to the C-terminal end of the Cry class of toxin genes and are usually found after a Cry gene that is not full-length and is missing the expected C-terminal region.

TABLE 1

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00326 | 1 | 2, 3 | | | Cry4A | 85, 90, 95, 96, 97, 98, 99 | 90, 95, 96, 97, 98, 99 | Cry4Aa2 (80.48% identity, 86.85% similarity)<br>ABM97547.1 (79.57% identity, 86.35% similarity)<br>ABR12216.1 (79.24% identity, 86.02% similarity)<br>A9XI31_BACTU (79.16% identity, 85.94% similarity) |
| APG00343 | 4 | 5 | | | Cry | 60, 65, 70, 75, 80, 85, 90, 95, 96, 97, 98, 99 | 75, 80, 85, 90, 95, 96, 97, 98, 99 | APG00514 (89.36% identity, 94.53% similarity)<br>APG00654 (80.12% identity, 87.72% similarity)<br>APG00164 (77.19% identity, 84.36% similarity)<br>CBL59393.1 (56.49% identity, 72.61% similarity) |

TABLE 1-continued Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| | | | | | | | | CBL59396.1 (56.49% identity, 72.47% similarity)<br>D5H3I8_BACTG (56.35% identity, 72.47% similarity)<br>APG00084 (52.79% identity, 69.81% similarity)<br>Cry8Aa1 (35.34% identity, 43.05% similarity) |
| APG00383 | 6 | 7 | | | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 | APG00101 (96.93% identity, 97.16% similarity)<br>APG00034 (61.93% identity, 74.85% similarity)<br>APG00048 (52.09% identity, 63.77% similarity)<br>US_2011_0231963_A1-9 (37.27% identity, 51.39% similarity)<br>Cry13Aa1 (36.96% identity, 53.97% similarity) |
| APG00493 | 8 | 9 | | | Mtx | 90, 95, 96, 97, 98, 99 | 90, 95, 96, 97, 98, 99 | WP_020294695.1 (85.08% identity, 89.15% similarity)<br>US20140007292A1_4 (84.41% identity, 88.81% similarity)<br>US20140007292A1_2 (82.71% identity, 88.14% similarity)<br>US20140007292A1_332 (76.61% identity, 83.39% similarity)<br>APG00659 (72.26% identity, 80.0% similarity) |
| APG00494 | 10 | 11 | | | Bin | 90, 95, 96, 97, 98, 99 | 95, 96, 97, 98, 99 | APG00731 (89.01% identity, 93.03% similarity)<br>APG00669 (88.2% identity, 92.49% similarity)<br>APG00035 (87.67% identity, 92.76% similarity)<br>APG00568 (86.86% identity, 91.96% similarity)<br>WP_000143307.1 (86.6% identity, 91.69% similarity)<br>APG00356 (86.6% identity, 91.96% similarity)<br>APG00284 (86.06% identity, 92.23% similarity)<br>WP_000143308.1 (85.79% identity, 91.69% similarity)<br>WP_050845516.1 (84.18% identity, 90.35% similarity)<br>APG00735 (75.19% identity, 82.78% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00495 | 12 | 13 | | | Mtx | 80, 85, 90, 95, 96, 97, 98, 99 | 85, 90, 95, 96, 97, 98, 99 | Cry35Ac2 (22.22% identity, 41.06% similarity) WP_016099228.1 (75.77% identity, 82

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00524 | 17 | 18, 19 | | | Cry14 | 55, 60, 65, 70, 75, 80, 85, 90, 95, 96, 97, 98, 99 | 70, 75, 80, 85, 90, 95, 96, 97, 98, 99 | APG00651 (77.43% identity, 84.21% similarity) Cry14Aa1 (54.15% identity, 67.51% similarity) APG00052 (52.77% identity, 65.77% similarity) Cry21Ba1 (45.51% identity, 61.62% similarity) Cry21Ca2 (43.99% identity, 60.21% similarity) |
| APG00528 | 20 | | | | Mtx | 55, 60, 65, 70, 75, 80, 85, 90, 95, 96, 97, 98, 99 | 65, 70, 75, 80, 85, 90, 95, 96, 97, 98, 99 | APG00661 (57.14% identity, 66.98% similarity) US_2008_0070829_A1-25 (54.57% identity, 64.87% similarity) AGA40029.1 (53.41% identity, 62.82% similarity) CAA63374.1 (41.55% identity, 51.37% similarity) AGA40031.1 (41.41% identity, 54.12% similarity) |
| APG00533 | 21 | | | | Cry11B | 80, 85, 90, 95, 96, 97, 98, 99 | 85, 90, 95, 96, 97, 98, 99 | APG00607 (97.89% identity, 97.89% similarity) Cry11Bb1 (77.26% identity, 84.18% similarity) ADI59541.1 (74.56% identity, 80.60% similarity) Cry11Ba1 (74.13% identity, 82.44% similarity) AEK06469.1 (67.07% identity, 73.79% similarity) |
| APG00534 | 22 | 23 | | | Cry | 50, 55, 60, 65, 70, 75, 80, 85, 90, 95, 96, 97, 98, 99 | 65, 70, 75, 80, 85, 90, 95, 96, 97, 98, 99 | APG00120 (82.82% identity, 88.17% similarity) WP_001070417.1 (45.9% identity, 60.78% similarity) Cry41Ba2 (44.35% identity, 59.13% similarity) Cry41Aa1 (41.39% identity, 56.51% similarity) Cry41Ab1 (38.61% identity, 54.79% similarity) |
| APG00536 | 24 | 25, 26 | | | Cry | 85, 90, 95, 96, 97, 98, 99 | 90, 95, 96, 97, 98, 99 | WO_2014_138339-52 (83.47% identity, 88.74% similarity) APG00046 (83.47% identity, 88.74% similarity) WO_2014_138339-53 (83.35% identity, 88.5% similarity) WO_2014_138339-54 (76.65% identity, 80.24% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00537 | 27 | 28, 29 | | 30 | Cry53A | 85, 90, 95, 96, 97, 98, 99 | 90, 95, 96, 97, 98, 99 | Cry68Aa1 (33.02% identity, 46.38% similarity) AGP17986.1 (83.11% identity, 87.81% similarity) WP_014990538.1 (80.7% identity, 86.26% similarity) ACP43734.1 (80.26% identity, 85.96% similarity) APG00606 (77.73% identity, 82.82% similarity) Cry53Aa1 (77.29% identity, 83.41% similarity) |
| APG00543 | 31 | 32 | | | Cry27A | 90, 95, 96, 97, 98, 99 | 95, 96, 97, 98, 99 | WP_016098322.1 (89.92% identity, 94.26% similarity) AGV55018.1 (86.13% identity, 89.02% similarity) Cry27Aa1 (75.99% identity, 83.43% similarity) WO_2014_102697-1 (40.07% identity, 53.93% similarity) WO_2014_102697-2 (39.83% identity, 53.39% similarity) |
| APG00555 | 33 | 34, 35 | | | Cry | 75, 80, 85, 90, 95, 96, 97, 98, 99 | 85, 90, 95, 96, 97, 98, 99 | CA_2843744-20 (71.12% identity, 80.7% similarity) CA_2843744-22 (69.81% identity, 79.1% similarity) APG01028 (66.91% identity, 76.83% similarity) US20130227743A1_26 (59.91% identity, 73.13% similarity) APG00039 (50.93% identity, 63.04% similarity) Cry53Aa1 (39.83% identity, 55.76% similarity) |
| APG00557 | 36 | 37 | | | Bin | 30, 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 | APG00050 (60.99% identity, 71.39% similarity) APG00461 (46.58% identity, 59.62% similarity) APG00474 (43.05% identity, 53.67% similarity) APG00629 (42.52% identity, 56.78% similarity) Cry49Aa1 (29.92% identity, 42.37% similarity) |

TABLE 1-continued

| Summary of SEQ ID NOs, Gene Class, and Variants thereof | | | | | | | | |
|---|---|---|---|---|---|---|---|---|
| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
| APG00558 | 38 | 39, 40 | | | Cry | 45, 50, 55, 60, 65, 70, 75, 80, 85, 90, 95, 96, 97, 98, 99 | 60, 65, 70, 75, 80, 85, 90, 95, 96, 97, 98, 99 | AGV55021.1 (42.52% identity, 56.5% similarity)<br>APG00153 (36.59% identity, 50.49% similarity)<br>Cry53Aa1 (33.51% identity, 50.0% similarity) |
| APG00565 | 41 | 42, 43 | | | Cry30D | 90, 95, 96, 97, 98, 99 | 95, 96, 97, 98, 99 | Cry30Db1 (88.73% identity, 90.87% similarity)<br>Cry30Da1 (86.31% identity, 89.87% similarity)<br>Cry30Ga2 (70.54% identity, 78.19% similarity)<br>Cry30Ga1 (69.97% identity, 77.76% similarity)<br>ADK47393.1 (69.96% identity, 77.86% similarity)<br>APG00972 (63.5% identity, 75.94% similarity) |
| APG00566 | 44 | 45 | | | Mtx | 75, 80, 85, 90, 95, 96, 97, 98, 99 | 85, 90, 95, 96, 97, 98, 99 | APG01086 (97.39% identity, 99.02% similarity)<br>APG00201 (82.03% identity, 91.5% similarity)<br>APG00006 (80.07% identity, 90.52% similarity)<br>APG00260 (78.43% identity, 88.24% similarity)<br>APG00036 (75.24% identity, 84.04% similarity)<br>APG00022 (75.16% identity, 83.33% similarity)<br>WP_000963933.1 (73.62% identity, 84.04% similarity)<br>US20130227743A1_100 (72.22% identity, 83.33% similarity)<br>US20130227743A1_60 (45.1% identity, 50.33% similarity)<br>ABV97497.1 (24.15% identity, 39.49% similarity) |
| APG00572 | 46 | | | | PI-PLC | 40, 45, 50, 55, 60, 65, 70, 75, 80, 85, 90, 95, 96, 97, 98, 99 | 55, 60, 65, 70, 75, 80, 85, 90, 95, 96, 97, 98, 99 | WP_016084067.1 (38.65% identity, 50.15% similarity)<br>WP_000836979.1 (38.12% identity, 49.85% similarity)<br>EEM93103.1 (37.91% identity, 49.05% similarity)<br>Cry73Aa (17.75% identity, 29.44% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00587 | 47 | 48 | | | Cry | 50, 55, 60, 65, 70, 75, 80, 85, 90, 95, 96, 97, 98, 99 | 65, 70, 75, 80, 85, 90, 95, 96, 97, 98, 99 | WP_048536363.1 (45.21% identity, 60.54% similarity) WP_048536362.1 (31.16% identity, 46.29% similarity) US20130227743A1_200 (27.52% identity, 44.36% similarity) Cry42Aa1 (14.96% identity, 24.9% similarity) |
| APG00939 | 49 | 50 | | | Vip3 | 95, 96, 97, 98, 99 | 97, 98, 99 | WP_048517127.1 (94.07% identity, 96.88% similarity) APG00077 (81.86% identity, 88.35% similarity) APG00278 (81.14% identity, 86.94% similarity) APG00875 (80.82% identity, 86.19% similarity) APG00173 (80.0% identity, 86.19% similarity) APG00175 (80.0% identity, 86.6% similarity) APG00657 (73.63% identity, 82.73% similarity) APG01003 (72.64% identity, 80.23% similarity) WP_050001316.1 (67.11% identity, 78.07% similarity) CA_2866166-1528 (23.27% identity, 39.55% similarity) Vip3Aa18 (23.21% identity, 40.48% similarity) |
| APG00606 | 51 | 52, 53 | | | Cry53 | 80, 85, 90, 95, 96, 97, 98, 99 | 85, 90, 95, 96, 97, 98, 99 | APG00537 (77.73% identity, 82.82% similarity) WP_014990538.1 (76.17% identity, 82.6% similarity) ACP43734.1 (76.02% identity, 82.6% similarity) AGP17986.1 (75.98% identity, 82.53% similarity) Cry53Aa1 (71.93% identity, 79.68% similarity) APG01028 (54.05% identity, 66.71% similarity) |
| APG00607 | 54 | | | | Cry11B | 80, 85, 90, 95, 96, 97, 98, 99 | 85, 90, 95, 96, 97, 98, 99 | APG00533 (97.89% identity, 97.89% similarity) Cry11Bb1 (77.49% identity, 83.77% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00608 | 55 | 56 | | | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 | APG00034 (49.72% identity, 62.43% similarity) APG00002 (44.42% identity, 56.00% similarity) APG00383 (43.43% identity, 58.13% similarity) APG00101 (42.70% identity, 56.97% similarity) APG00048 (40.55% identity, 54.86% similarity) Cry13Aa1 (38.05% identity, 53.68% similarity) |
| APG00609 | 57 | | | | Mtx | 65, 70, 75, 80, 85, 90, 95, 96, 97, 98, 99 | 75, 80, 85, 90, 95, 96, 97, 98, 99 | APG00224 (63.1% identity, 73.52% similarity) AGA40030.1 (60.72% identity, 71.87% similarity) APG00513 (53.44% identity, 69.15% similarity) APG00846 (52.62% identity, 67.49% similarity) AGA40032.1 (39.61% identity, 54.21% similarity) CAA67205.1 (39.6% identity, 57.83% similarity) C4B693_CLOBO (20.11% identity, 35.92% similarity) |
| APG00622 | 58 | 59 | | | Cry5 | 60, 65, 70, 75, 80, 85, 90, 95, 96, 97, 98, 99 | 70, 75, 80, 85, 90, 95, 96, 97, 98, 99 | Cry5Ba1 (56.24% identity, 65.33% similarity) Cry5Ba2 (56.24% identity, 65.27% similarity) Cry5Ba3 (56.03% identity, 65.13% similarity) APG00217 (53.75% identity, 62.25% similarity) |
| APG00624 | 60 | 61 | | | Cyt | 45, 50, 55, 60, 65, 70, 75, 80, 85, 90, 95, 96, 97, 98, 99 | 60, 65, 70, 75, 80, 85, 90, 95, 96, 97, 98, 99 | Cyt1Da1 (43.72% identity, 58.52% similarity) WP_000079177.1 (42.96% identity, 60.14% similarity) WP_043939324.1 (42.42% identity, 59.28% similarity) |
| APG00637 | 62 | 63, 64 | | | Cry | 60, 65, 70, 75, 80, 85, 90, 95, 96, 97, 98, 99 | 70, 75, 80, 85, 90, 95, 96, 97, 98, 99 | APG00115 (92.62% identity, 94.99% similarity) US_2015_0218583_A1-3 (57.11% identity, 65.14% similarity) EJR93120.1 (56.83% identity, 67.66% similarity) AGP18037.1 (54.79% identity, 64.79% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00638 | 65 | | | | PI-PLC | 80, 85, 90, 95, 96, 97, 98, 99 | 90, 95, 96, 97, 98, 99 | Cry32Ea1 (36.19% identity, 48.14% similarity) WP_050845433.1 (79.88% identity, 86.65% similarity) AGA40046.1 (68.23% identity, 79.34% similarity) WP_000513490.1 (67.84% identity, 78.36% similarity) |
| APG00641 | 66 | 67 | | | Mtx | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 | Cyt1Da1 (22.69% identity, 34.85% similarity) APG00807 (73.68% identity, 82.57% similarity) APG00434 (49.68% identity, 66.77% similarity) WP_054770413.1 (31.91% identity, 47.42% similarity) |
| APG00643 | 68 | 69 | | | Cry | 85, 90, 95, 96, 97, 98, 99 | 90, 95, 96, 97, 98, 99 | Cry64Aa1 (31.68% identity, 47.2% similarity) APG00800 (87.98% identity, 93.99% similarity) WP_012259841.1 (80.77% identity, 88.77% similarity) US20130227743A1_24 (78.12% identity, 84.75% similarity) APG00088 (64.81% identity, 75.19% similarity) WP_025988975.1 (62.92% identity, 67.17% similarity) |
| APG00644 | 70 | 71, 72 | | | Cry | 60, 65, 70, 75, 80, 85, 90, 95, 96, 97, 98, 99 | 65, 70, 75, 80, 85, 90, 95, 96, 97, 98, 99 | Cry8Ca1 (24.72% identity, 34.83% similarity) US20130227743A1_202 (58.97% identity, 63.99% similarity) WP_048536362.1 (20.86% identity, 34.16% similarity) AFU11621.1 (19.84% identity, 32.76% similarity) US20130227743A1_204 (19.27% identity, 32.47% similarity) |
| APG00648 | 73 | 74 | | | Bin | 70, 75, 80, 85, 90, 95, 96, 97, 98, 99 | 80, 85, 90, 95, 96, 97, 98, 99 | APG00261 (69.58% identity, 79.05% similarity) APG00988 (67.83% identity, 77.06% similarity) WP_001258160.1 (66.17% identity, 78.7% similarity) WP_001258161.1 (66.17% identity, 78.7% similarity) US20130227743A1_10 (66.0% identity, 78.5% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| | | | | | | | | APG00223 (61.22% identity, 71.43% similarity) APG00454 (61.22% identity, 71.43% similarity) APG00242 (61.0% identity, 71.2% similarity) APG00335 (60.77% identity, 71.2% similarity) APG00724 (55.9% identity, 68.19% similarity) APG00716 (55.09% identity, 69.23% similarity) APG00806 (52.8% identity, 64.96% similarity) Cry35Ab4 (22.58% identity, 38.02% similarity) |
| APG00649 | 75 | 76 | | | Bin | 70, 75, 80, 85, 90, 95, 96, 97, 98, 99 | 85, 90, 95, 96, 97, 98, 99 | APG00413 (69.63% identity, 81.68% similarity) APG00230 (68.23% identity, 81.25% similarity) WP_017154552.1 (67.72% identity, 80.31% similarity) WP_050001305.1 (67.62% identity, 79.9% similarity) US_2014_0033363_A1-2 (66.06% identity, 78.76% similarity) APG00596 (65.28% identity, 77.98% similarity) APG00373 (65.27% identity, 77.02% similarity) APG00090 (63.45% identity, 78.85% similarity) Cry35Ab2 (22.78% identity, 34.17% similarity) |
| APG00651 | 77 | 78 | | | Cry14 | 60, 65, 70, 75, 80, 85, 90, 95, 96, 97, 98, 99 | 75, 80, 85, 90, 95, 96, 97, 98, 99 | APG00524 (77.43% identity, 84.21% similarity) Cry14Aa1 (57.4% identity, 70.63% similarity) APG00052 (54.52% identity, 68.23% similarity) |
| APG00657 | 79 | 80 | | | Vip3 | 75, 80, 85, 90, 95, 96, 97, 98, 99 | 85, 90, 95, 96, 97, 98, 99 | APG00175 (74.79% identity, 82.85% similarity) APG00939 (73.63% identity, 82.73% similarity) APG00077 (73.33% identity, 81.8% similarity) WP_048517127.1 (73.21% identity, 82.55% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| | | | | | | | | APG00273 (72.12% identity, 81.66% similarity) APG00278 (71.29% identity, 80.48% similarity) APG00173 (71.03% identity, 80.48% similarity) APG01003 (67.97% identity, 78.06% similarity) WP_050001316.1 (66.7% identity, 78.35% similarity) Vip3Aa13 (23.92% identity, 39.9% similarity) |
| APG00659 | 81 | 82 | | | Mtx | 80, 85, 90, 95, 96, 97, 98, 99 | 85, 90, 95, 96, 97, 98, 99 | US20140007292A1_332 (79.39% identity, 84.46% similarity) CA_2878263-105 (78.04% identity, 84.8% similarity) US20140007292A1_2 (76.01% identity, 83.11% similarity) WP_020294695.1 (75.68% identity, 83.78% similarity) APG00493 (72.26% identity, 80.0% similarity) |
| APG00661 | 83 | | | | Mtx | 85, 90, 95, 96, 97, 98, 99 | 95, 96, 97, 98, 99 | APG06508 (96.41% identity, 97.31% similarity) APG09801 (94.91% identity, 97.01% similarity) US_2008_0070829_A1-25 (83.63% identity, 90.48% similarity) AGA40029.1 (74.63% identity, 84.78% similarity) CAA63374.1 (58.4% identity, 68.09% similarity) APG00528 (57.14% identity, 66.98% similarity) AGA40031.1 (46.57% identity, 63.58% similarity) |
| APG00662 | 84 | 85, 86 | | | Cry69 | 75, 80, 85, 90, 95, 96, 97, 98, 99 | 85, 90, 95, 96, 97, 98, 99 | APG00079 (77.58% identity, 85.14% similarity) CA_2753918-13 (72.5% identity, 80.38% similarity) US_2011_0197314_A1-13 (72.5% identity, 80.3% similarity) APG00786 (70.46% identity, 77.45% similarity) AFU17214.1 (66.67% identity, 76.58% similarity) APG00059 (65.69% identity, 75.59% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00663 | 87 | 88 | | | Cry5 | 50, 55, 60, 65, 70, 75, 80, 85, 90, 95, 96, 97, 98, 99 | 65, 70, 75, 80, 85, 90, 95, 96, 97, 98, 99 | Cry69Aa1 (63.54% identity, 73.38% similarity) APG00217 (51.48% identity, 62.91% similarity) Cry5Ca2 (49.46% identity, 61.2% similarity) Cry5Ba1 (49.27% identity, 60.66% similarity) Cry5Ba3 (49.16% identity, 60.75% similarity) Cry5Ba2 (49.12% identity, 60.58% similarity) |
| APG00664 | 89 | 90 | | | Cry54 | 65, 70, 75, 80, 85, 90, 95, 96, 97, 98, 99 | 75, 80, 85, 90, 95, 96, 97, 98, 99 | AGA40050.1 (60.55% identity, 72.55% similarity) Cry54Aa2 (59.72% identity, 71.59% similarity) APG00864 (58.9% identity, 70.48% similarity) Cry54Aa1 (56.40% identity, 68.39% similarity) AFU17297.1 (55.65% identity, 66.80% similarity) |
| APG00672 | 91 | 92 | | | Cry | 95, 96, 97, 98, 99 | 96, 97, 98, 99 | AGA40064.1 (91.5% identity, 95.46% similarity) APG00045 (83.92% identity, 90.26% similarity) APG00110 (61.34% identity, 73.07% similarity) WP_016110336.1 (49.54% identity, 63.7% similarity) AGP18054.1 (31.23% identity, 47.85% similarity) Cry70Ba1 (23.84% identity, 40.99% similarity) |
| APG00673 | 93 | 94, 95 | | | Cry32 | 70, 75, 80, 85, 90, 95, 96, 97, 98, 99 | 80, 85, 90, 95, 96, 97, 98, 99 | Cry32Ea1 (66.69% identity, 75.3% similarity) AGU13851.1 (66.69% identity, 75.19% similarity) APG00054 (59.06% identity, 69.02% similarity) APG00310 (57.34% identity, 67.43% similarity) APG00068 (56.63% identity, 68.54% similarity) APG00469 (54.97% identity, 66.89% similarity) APG00710 (51.05% identity, 61.25% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00674 | 96 | | | | Bin | 40, 45, 50, 55, 60, 65, 70, 75, 80, 85, 90, 95, 96, 97, 98, 99 | 55, 60, 65, 70, 75, 80, 85, 90, 95, 96, 97, 98, 99 | APG00687 (50.5% identity, 61.08% similarity) APG00472 (71.06% identity, 83.67% similarity) APG00642 (69.71% identity, 80.86% similarity) WP_029439068.1 (35.26% identity, 50.96% similarity) WP_002187944.1 (31.71% identity, 47.56% similarity) WP_028595059.1 (31.41% identity, 47.49% similarity) Cry35Aa2 (24.76% identity, 40.0% similarity) |
| APG00675 | 97 | | | | Vip3 | 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 | APG00131 (62.46% identity, 78.65% similarity) APG00181 (60.35% identity, 74.87% similarity) APG00038 (60.35% identity, 74.26% similarity) Vip3Ba1 (30.77% identity, 44.23% similarity) |
| APG00677 | 98 | | | | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 | APG00003 (65.55% identity, 77.44% similarity) BAE79727.1 (35.46% identity, 51.52% similarity) KIQ78015.1 (34.63% identity, 50.13% similarity) US20130227743A1_74 (34.18% identity, 49.67% similarity) Cry4Aa1 (21.23% identity, 30.85% similarity) |
| APG00679 | 99 | 100 | | | Cry1D | 80, 85, 90, 95, 96, 97, 98, 99 | 90, 95, 96, 97, 98, 99 | Cry1Db1 (77.55% identity, 85.86% similarity) Cry1Da1 (77.52% identity, 84.87% similarity) Cry1Db2 (77.46% identity, 85.78% similarity) AEH31432.1 (77.35% identity, 85.04% similarity) WP_000405159.1 (77.35% identity, 85.13% similarity) |
| APG00687 | 101 | 102 | 103 | | Cry32C | 90, 95, 96, 97, 98, 99 | 95, 96, 97, 98, 99 | AGU13873.1 (85.7% identity, 90.23% similarity) Cry32Ca1 (84.22% identity, 89.92% similarity) APG00710 (55.17% identity, 65.22% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| | | | | | | | | APG00430 (54.82% identity, 64.77% similarity) APG00469 (53.5% identity, 64.89% similarity) APG00056 (52.93% identity, 65.09% similarity) APG00058 (50.85% identity, 63.43% similarity) APG00105 (50.75% identity, 62.69% similarity) APG00673 (50.5% identity, 61.08% similarity) |
| APG00688 | 104 | 105 | | | Cry | 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 | AGU13850.1 (36.79% identity, 44.66% similarity) AGU13871.1 (34.44% identity, 43.46% similarity) AGU13875.1 (32.76% identity, 40.49% similarity) Cry32Ea1 (29.64% identity, 40.09% similarity) |
| APG00693 | 106 | 107, 108 | | | Mtx | 85, 90, 95, 96, 97, 98, 99 | 90, 95, 96, 97, 98, 99 | AGP17978.1 (81.23% identity, 88.0% similarity) WP_016099228.1 (80.62% identity, 86.46% similarity) APG00495 (70.06% identity, 79.64% similarity) EEM56710.1 (50.46% identity, 66.57% similarity) WP_008180054.1 (50.0% identity, 65.85% similarity) |
| APG00695 | 109 | 110, 111 | | 112 | Cry40D | 80, 85, 90, 95, 96, 97, 98, 99 | 90, 95, 96, 97, 98, 99 | Cry40Da1 (79.91% identity, 86.06% similarity) APG00204 (61.61% identity, 74.7% similarity) APG00111 (52.52% identity, 61.84% similarity) |
| APG00701 | 113 | 114 | | | Bin | 70, 75, 80, 85, 90, 95, 96, 97, 98, 99 | 85, 90, 95, 96, 97, 98, 99 | WP_002191947.1 (69.07% identity, 81.44% similarity) APG00243 (68.99% identity, 80.36% similarity) WP_000839920.1 (68.86% identity, 80.51% similarity) WP_002166959.1 (68.81% identity, 81.44% similarity) APG00065 (66.91% identity, 77.94% similarity) APG00459 (66.1% identity, 77.8% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| | | | | | | | | APG00412 (65.83% identity, 77.64% similarity) APG00132 (65.6% identity, 78.87% similarity) APG00806 (64.75% identity, 77.75% similarity) APG00716 (63.5% identity, 77.89% similarity) APG00724 (63.05% identity, 74.88% similarity) APG00988 (61.32% identity, 75.06% similarity) Cry35Ab3 (23.53% identity, 38.82% similarity) |
| APG00702 | 115 | 116 | | | Cry | 65, 70, 75, 80, 85, 90, 95, 96, 97, 98, 99 | 75, 80, 85, 90, 95, 96, 97, 98, 99 | WP_048536362.1 (62.74% identity, 70.16% similarity) APG00401 (60.03% identity, 71.78% similarity) APG00255 (59.87% identity, 71.62% similarity) WP_048536324.1 (43.52% identity, 56.17% similarity) WP_048536363.1 (33.39% identity, 49.37% similarity) Cry73Aa (19.2% identity, 29.02% similarity) |
| APG00703 | 117 | 118, 119 | | | Cry | 80, 85, 90, 95, 96, 97, 98, 99 | 85, 90, 95, 96, 97, 98, 99 | AGP18005.1 (77.0% identity, 84.57% similarity) AGA40033.1 (51.02% identity, 64.04% similarity) AEH76823.1 (49.6% identity, 61.56% similarity) Cry21Ca2 (40.2% identity, 55.84% similarity) |
| APG00705 | 120 | 121, 122, 123, 124, 125 | | | Cry70B | 95, 96, 97, 98, 99 | 96, 97, 98, 99 | ETT82181.1 (91.91% identity, 95.59% similarity) Cry70Bb1 (91.67% identity, 95.71% similarity) WP_016093954.1 (91.67% identity, 95.34% similarity) APG00526 (86.9% identity, 92.53% similarity) APG00025 (84.82% identity, 91.55% similarity) APG00728 (84.09% identity, 90.94% similarity) APG00595 (65.25% identity, 77.64% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00706 | 126 | | | | Bin | 40, 45, 50, 55, 60, 65, 70, 75, 80, 85, 90, 95, 96, 97, 98, 99 | 55, 60, 65, 70, 75, 80, 85, 90, 95, 96, 97, 98, 99 | APG00027 (57.19% identity, 72.54% similarity) APG00063 (39.49% identity, 51.87% similarity) Cry49Ab1 (39.13% identity, 52.96% similarity) |
| APG00707 | 127 | 128 | | | Mtx | 60, 65, 70, 75, 80, 85, 90, 95, 96, 97, 98, 99 | 75, 80, 85, 90, 95, 96, 97, 98, 99 | APG00939 (55.76% identity, 68.48% similarity) AGA40045.1 (55.49% identity, 71.04% similarity) APG00146 (50.47% identity, 66.36% similarity) APG00351 (50.14% identity, 65.13% similarity) WP_000794514.1 (49.84% identity, 67.29% similarity) US20130227743A1_102 (46.27% identity, 62.11% similarity) ETK27180.1 (41.61% identity, 56.52% similarity) |
| APG00710 | 129 | 130, 131 | | | Cry32 | 95, 96, 97, 98, 99 | 95, 96, 97, 98, 99 | AGU13855.1 (91.28% identity, 94.34% similarity) US20110203014_23 (89.51% identity, 92.47% similarity) AGU13869.1 (89.43% identity, 92.47% similarity) APG00430 (78.11% identity, 83.98% similarity) APG00056 (69.24% identity, 79.31% similarity) APG00058 (66.26% identity, 75.28% similarity) APG00687 (55.17% identity, 65.22% similarity) Cry32Ab1 (53.65% identity, 64.62% similarity) APG00469 (53.09% identity, 64.73% similarity) APG00504 (52.35% identity, 64.28% similarity) APG00673 (51.24% identity, 61.54% similarity) |
| APG00718 | 132 | | | | Cry | 40, 45, 50, 55, 60, 65, 70, 75, 80, 85, 90, 95, 96, 97, 98, 99 | 60, 65, 70, 75, 80, 85, 90, 95, 96, 97, 98, 99 | APG00860 (54.49% identity, 73.08% similarity) AGA40044.1 (38.97% identity, 55.59% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00721 | 133 | 134 | | 135 | Cry65 | 55, 60, 65, 70, 75, 80, 85, 90, 95, 96, 97, 98, 99 | 65, 70, 75, 80, 85, 90, 95, 96, 97, 98, 99 | APG00136 (95.85% identity, 97.36% similarity) Cry65Aa2 (51.84% identity, 60.91% similarity) APG00123 (38.24% identity, 51.05% similarity) |
| APG00722 | 136 | | | | Bin | 70, 75, 80, 85, 90, 95, 96, 97, 98, 99 | 80, 85, 90, 95, 96, 97, 98, 99 | AGP18023.1 (67.35% identity, 78.52% similarity) APG00340 (65.84% identity, 76.4% similarity) APG00151 (65.25% identity, 76.01% similarity) US20130227743A1_40 (65.12% identity, 72.03% similarity) US20130227743A1_48 (36.16% identity, 45.72% similarity) Cry4Ba4 (25.42% identity, 34.99% similarity) |
| APG00724 | 137 | 138 | | | Bin | 70, 75, 80, 85, 90, 95, 96, 97, 98, 99 | 80, 85, 90, 95, 96, 97, 98, 99 | APG00407 (88.61% identity, 94.31% similarity) APG00385 (81.89% identity, 88.83% similarity) APG00419 (78.47% identity, 84.65% similarity) APG00229 (77.91% identity, 83.01% similarity) APG00767 (73.18% identity, 82.82% similarity) APG00716 (73.15% identity, 81.03% similarity) WP_002166959.1 (68.46% identity, 77.51% similarity) WP_002191947.1 (68.22% identity, 77.51% similarity) WP_000839920.1 (68.06% identity, 79.12% similarity) APG00806 (67.08% identity, 79.7% similarity) APG00701 (63.05% identity, 74.88% similarity) APG00988 (60.78% identity, 71.32% similarity) Cry35Ac1 (21.46% identity, 36.91% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00726 | 139 | 140, 141 | | | Cry | 75, 80, 85, 90, 95, 96, 97, 98, 99 | 85, 90, 95, 96, 97, 98, 99 | CA_2843744-9 (71.01% identity, 81.16% similarity) CA_2843744-7 (68.68% identity, 78.64% similarity) US20130227743A1_74 (36.45% identity, 51.31% similarity) Cry54Ba1 (34.34% identity, 47.11% similarity) |
| APG00729 | 142 | 143 | | | Bin | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 | WP_048517129.1 (30.75% identity, 47.94% similarity) WP_048548696.1 (30.37% identity, 46.03% similarity) WP_002090518.1 (29.98% identity, 47.96% similarity) Cry35Ab5 (24.7% identity, 38.37% similarity) |
| APG00735 | 144 | 145 | | | Bin | 85, 90, 95, 96, 97, 98, 99 | 90, 95, 96, 97, 98, 99 | APG00356 (84.81% identity, 89.11% similarity) APG00568 (84.56% identity, 89.11% similarity) APG00287 (83.8% identity, 88.1% similarity) APG00157 (83.04% identity, 88.1% similarity) APG00377 (82.78% identity, 88.35% similarity) APG00231 (82.53% identity, 87.85% similarity) WP_050845516.1 (80.76% identity, 86.84% similarity) AEX56523.1 (80.51% identity, 86.33% similarity) APG00494 (75.19% identity, 82.78% similarity) WP_000143307.1 (75.19% identity, 83.29% similarity) Cry35Ac2 (21.33% identity, 37.61% similarity) |
| APG00781 | 146 | 147 | | | Cry68 | 75, 80, 85, 90, 95, 96, 97, 98, 99 | 85, 90, 95, 96, 97, 98, 99 | WP_016083794.1 (71.85% identity, 82.25% similarity) APG00026 (71.2% identity, 80.64% similarity) CA_2753918-14 (70.55% identity, 79.88% similarity) APG00109 (68.01% identity, 77.56% similarity) AFU17323.1 (66.24% identity, 74.1% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00784 | 148 | 149 | | | Cry | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 | Cry68Aa1 (66.13% identity, 73.99% similarity) APG00099 (95.29% identity, 96.86% similarity) APG00801 (84.55% identity, 90.37% similarity) Cry13Aa1 (30.61% identity, 45.66% similarity) |
| APG00785 | 150 | 151, 152 | | | Cry50 | 80, 85, 90, 95, 96, 97, 98, 99 | 90, 95, 96, 97, 98, 99 | AGA40023.1 (77.24% identity, 85.06% similarity) US20130227743A1_78 (61.79% identity, 74.2% similarity) KIQ78153.1 (61.54% identity, 73.57% similarity) Cry50Ba1 (50.9% identity, 63.25% similarity) |
| APG00786 | 153 | 154, 155 | | | Cry69 | 95, 96, 97, 98, 99 | 95, 96, 97, 98, 99 | US_2011_0197314_A1-13 (91.13% identity, 92.98% similarity) CA_2753918-13 (90.92% identity, 92.77% similarity) APG00662 (70.46% identity, 77.45% similarity) APG00079 (68.76% identity, 76.11% similarity) WP_016084057.1 (64.86% identity, 74.7% similarity) APG00059 (64.27% identity, 74.75% similarity) Cry69Aa1 (59.64% identity, 69.36% similarity) |
| APG00787 | 156 | 157 | | | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 | APG00723 (50.82% identity, 62.48% similarity) WP_048536362.1 (38.59% identity, 52.5% similarity) AGA40057.1 (33.33% identity, 46.48% similarity) WP_017762581.1 (29.66% identity, 40.4% similarity) AGA40058.1 (28.99% identity, 42.17% similarity) |
| APG00799 | 158 | 159 | | | Cry | 25, 30, 35, 40, 45, 50, 55, 60, 65, 70, 75, 80, 85, 90, 95, 96, 97, 98, 99 | 40, 45, 50, 55, 60, 65, 70, 75, 80, 85, 90, 95, 96, 97, 98, 99 | C0ZKJ5_BREBN (23.19% identity, 37.57% similarity) Cry5Ad1 (21.24% identity, 32.24% similarity) |
| APG00801 | 160 | 161 | | | Cry | 30, 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 | APG00099 (85.30% identity, 90.68% similarity) APG00784 (84.55% identity, 90.37% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00802 | 162 | 163 | | | Cry19 | 55, 60, 65, 70, 75, 80, 85, 90, 95, 96, 97, 98, 99 | 70, 75, 80, 85, 90, 95, 96, 97, 98, 99 | Cry13Aa1 (29.5% identity, 45.1% similarity) Cry19

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG00810 | 171 | 172, 173 | | | Cry20 | 60, 65, 70, 75, 80, 85, 90, 95, 96, 97, 98, 99 | 70, 75, 80, 85, 90, 95, 96, 97, 98, 99 | Cry64Aa1 (32.69% identity, 48.08% similarity) AGV55017.1 (57.12% identity, 68.39% similarity) WP_016098327.1 (53.01% identity, 64.12% similarity) Cry20Ba2 (52.47% identity, 62.58% similarity) |
| APG00864 | 174 | | | | Cry54A | 85, 90, 95, 96, 97, 98, 99 | 95, 96, 97, 98, 99 | AGA40050.1 (84.65% identity, 90.2% similarity) Cry54Aa2 (83.63% identity, 89.18% similarity) APG00664 (58.9% identity, 70.48% similarity) |
| APG00912 | 175 | 176, 177 | 178 | | Cry | 70, 75, 80, 85, 90, 95, 96, 97, 98, 99 | 80, 85, 90, 95, 96, 97, 98, 99 | AEH76820.1 (69.56% identity, 78.62% similarity) US20100298211A1_8 (65.27% identity, 73.73% similarity) US20130227743A1_48 (55.33% identity, 70.45% similarity) Cry32Ea1 (44.82% identity, 57.88% similarity) |
| APG00960 | 179 | 180, 181 | | | Cry7 | 95, 96, 97, 98, 99 | 95, 96, 97, 98, 99 | AGU13819.1 (90.49% identity, 94.42% similarity) AGM39662.1 (88.66% identity, 93.37% similarity) AGU13834.1 (87.78% identity, 93.28% similarity) Cry7Ab3 (58.23% identity, 69.62% similarity) |
| APG00972 | 182 | 183, 184 | | | Cry30F | 90, 95, 96, 97, 98, 99 | 95, 96, 97, 98, 99 | CA_2753918-15 (85.29% identity, 90.76% similarity) AFU17333.1 (84.87% identity, 90.48% similarity) WP_000806152.1 (81.65% identity, 87.25% similarity) Cry30Fa1 (80.81% identity, 86.69% similarity) APG00565 (63.5% identity, 75.94% similarity) |
| APG00980 | 185 | 186, 187 | | | Mtx | 65, 70, 75, 80, 85, 90, 95, 96, 97, 98, 99 | 75, 80, 85, 90, 95, 96, 97, 98, 99 | AGA40045.1 (61.81% identity, 71.14% similarity) APG00351 (58.84% identity, 72.46% similarity) APG00939 (58.52% identity, 69.32% similarity) US20130227743A1_102 (56.65% identity, 69.08% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| | | | | | | | | APG00146 (55.46% identity, 69.32% similarity) APG00387 (55.3% identity, 67.91% similarity) WP_000794514.1 (54.28% identity, 69.32% similarity) APG00938 (51.83% identity, 65.07% similarity) WP_036654376.1 (41.38% identity, 56.32% similarity) |
| APG00981 | 188 | 189 | | | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 | APG00076 (85.87% identity, 91.14% similarity) CA_2843744-7 (39.07% identity, 54.08% similarity) CA_2843744-9 (38.92% identity, 54.29% similarity) US20130227743A1_74 (34.23% identity, 50.19% similarity) Cry4Cc1 (21.66% identity, 32.04% similarity) |
| APG00986 | 190 | 191, 192 | | 193 | Cry56 | 85, 90, 95, 96, 97, 98, 99 | 90, 95, 96, 97, 98, 99 | AGV55019.1 (81.41% identity, 86.81% similarity) ACR88315.1 (63.53% identity, 75.44% similarity) WP_050845711.1 (54.32% identity, 69.79% similarity) Cry56Aa2 (54.3% identity, 69.73% similarity) |
| APG00988 | 194 | 195 | | | Bin | 75, 80, 85, 90, 95, 96, 97, 98, 99 | 90, 95, 96, 97, 98, 99 | WP_002114997.1 (73.67% identity, 81.01% similarity) WP_002187944.1 (73.67% identity, 85.06% similarity) WP_001258160.1 (72.91% identity, 84.56% similarity) APG00213 (72.49% identity, 82.26% similarity) APG00243 (72.35% identity, 82.43% similarity) APG00412 (71.21% identity, 80.56% similarity) APG00844 (70.28% identity, 81.65% similarity) APG00118 (67.96% identity, 76.43% similarity) APG00648 (67.83% identity, 77.06% similarity) APG00716 (65.9% identity, 76.41% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| | | | | | | | | APG00724 (60.78% identity, 71.32% similarity) APG00806 (59.25% identity, 71.25% similarity) Cry35Ab4 (23.15% identity, 40.33% similarity) |
| APG01000 | 196 | 197 | | | Bin | 30, 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 | WP_002090518.1 (26.42% identity, 40.16% similarity) WP_048517129.1 (26.3% identity, 40.55% similarity) WP_016093722.1 (26.22% identity, 41.35% similarity) Cry49Ab1 (16.28% identity, 24.74% similarity) |
| APG01003 | 198 | 199 | | | Vip3 | 80, 85, 90, 95, 96, 97, 98, 99 | 90, 95, 96, 97, 98, 99 | APG00875 (87.19% identity, 90.21% similarity) APG00278 (85.25% identity, 90.06% similarity) APG00173 (85.18% identity, 89.77% similarity) APG00358 (81.35% identity, 87.4% similarity) APG00273 (78.16% identity, 85.2% similarity) WP_050001316.1 (75.08% identity, 85.24% similarity) APG00939 (72.64% identity, 80.23% similarity) WP_048517127.1 (72.11% identity, 79.78% similarity) APG00657 (67.97% identity, 78.06% similarity) AIT93175.1 (23.47% identity, 39.55% similarity) Vip3Ad2 (23.32% identity, 39.53% similarity) |
| APG01028 | 200 | 201, 202 | | 203 | Cry | 85, 90, 95, 96, 97, 98, 99 | 90, 95, 96, 97, 98, 99 | CA_2753918-17 (81.0% identity, 87.71% similarity) APG00555 (66.91% identity, 76.83% similarity) US20130227743A1_26 (61.01% identity, 72.81% similarity) APG00606 (54.05% identity, 66.71% similarity) ACP43734.1 (41.05% identity, 55.06% similarity) Cry53Aa1 (40.14% identity, 54.69% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG01112 | 204 | | | | Cry | 30, 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 | APG00603 (79.84% identity, 81.48% similarity) WP_017762616.1 (26.86% identity, 41.34% similarity) WP_044306756.1 (26.77% identity, 40.34% similarity) US20130227743A1_206 (23.74% identity, 37.77% similarity) AGA40058.1 (22.9% identity, 35.14% similarity) |
| APG00556 | 205 | | 206 | | Mtx | 65, 70, 75, 80, 85, 90, 95, 96, 97, 98, 99 | 80, 85, 90, 95, 96, 97, 98, 99 | APG00623 (88.97% identity, 91.18% similarity) APG01037 (88.97% identity, 91.54% similarity) US_2014_0283208_A1-2 (61.29% identity, 76.34% similarity) WO_2014_159836-52 (60.93% identity, 76.34% similarity) WO_2014_159836-61 (60.93% identity, 76.34% similarity) Cry46Ab (38.31% identity, 56.17% similarity) |
| APG00623 | 207 | | | | Mtx | 65, 70, 75, 80, 85, 90, 95, 96, 97, 98, 99 | 85, 90, 95, 96, 97, 98, 99 | APG01037 (98.02% identity, 99.21% similarity) APG00556 (88.97% identity, 91.18% similarity) US_2014_0283208_A1-2 (64.34% identity, 81.4% similarity) WO_2014_159836-52 (63.95% identity, 81.4% similarity) WO_2014_159836-61 (63.95% identity, 81.4% similarity) Cry46Ab (35.83% identity, 52.77% similarity) |
| APG01037 | 208 | 209, 210, 211, 212, 213, 214 | | | Mtx | 65, 70, 75, 80, 85, 90, 95, 96, 97, 98, 99 | 85, 90, 95, 96, 97, 98, 99 | APG00623 (98.02% identity, 99.21% similarity) APG00556 (88.97% identity, 91.54% similarity) US_2014_0283208_A1-2 (64.48% identity, 81.08% similarity) WO_2014_159836-52 (64.09% identity, 81.08% similarity) WO_2014_159836-61 (64.09% identity, 81.08% similarity) Cry46Ab (36.51% identity, 53.29% similarity) |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG01086 | 215 | 216 | | | Mtx | 75, 80, 85, 90, 95, 96, 97, 98, 99 | 85, 90, 95, 96, 97, 98, 99 | APG00566 (97.39% identity, 99.02% similarity) APG00201 (81.05% identity, 90.85% similarity) APG00006 (78.76% identity, 90.20% similarity) APG00260 (78.10% identity, 87.58% similarity) APG00036 (75.24% identity, 83.71% similarity) APG00022 (75.16% identity, 83.01% similarity) WP_000963933.1 (74.18% identity, 84.31% similarity) US_2013_0227743_A1-100 (72.88% identity, 83.66% similarity) US_2013_0227743_A1-99 (72.64% identity, 83.39% similarity) APG00345 (68.08% identity, 80.46% similarity) |
| APG06508 | 217 | | | | Mtx | 85, 90, 95, 96, 97, 98, 99 | 95, 96, 97, 98, 99 | APG00661 (96.41% identity, 97.31% similarity) APG09801 (95.47% identity, 96.68% similarity) US_8829279_B2-24 (84.13% identity, 90.12% similarity) US_8829279_B2-34 (75.60% identity, 84.94% similarity) US_8318900_B2-13 (75.30% identity, 84.64% similarity) |
| APG09801 | 218 | | | | Mtx | 85, 90, 95, 96, 97, 98, 99 | 90, 95, 96, 97, 98, 99 | APG06508 (95.47% identity, 96.68% similarity) APG00661 (94.91% identity, 97.01% similarity) US_8829279_B2-24 (81.74% identity, 89.22% similarity) US_8829279_B2-34 (76.28% identity, 84.98% similarity) US_8318900_B2-13 (75.98% identity, 84.68% similarity) |
| APG01037 | 208 | | | | | 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 | 60, 61, 62, 63, 64, 65, 66, 67, 68, 69, 70, 75, 80, 85, 86, 87, 88, 89, 90, 91, 92, 93, 94, 95, 96, 97, 98, 99 | |

TABLE 1-continued

Summary of SEQ ID NOs, Gene Class, and Variants thereof

| Gene Name | Full-length SEQ ID No. | Modified SEQ ID No.(s) | CryBP1 SEQ ID No. | Split-Cry C-terminus SEQ ID No. | Gene Class | Identity from nearest non-APG | Similarity from nearest non-APG | Homologs |
|---|---|---|---|---|---|---|---|---|
| APG01037.1 | 209 | | | | | 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 | 60, 61, 62, 63, 64, 65, 66, 67, 68, 69, 70, 75, 80, 85, 86, 87, 88, 89, 90, 91, 92, 93, 94, 95, 96, 97, 98, 99 | |
| APG00623 | 207 | | | | | 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 | 60, 61, 62, 63, 64, 65, 66, 67, 68, 69, 70, 75, 80, 85, 86, 87, 88, 89, 90, 91, 92, 93, 94, 95, 96, 97, 98, 99 | |
| APG00556 | 205 | | | | | 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 | 60, 61, 62, 63, 64, 65, 66, 67, 68, 69, 70, 75, 80, 85, 86, 87, 88, 89, 90, 91, 92, 93, 94, 95, 96, 97, 98, 99 | |
| APG00556.1 | 206 | | | | | 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 | 60, 61, 62, 63, 64, 65, 66, 67, 68, 69, 70, 75, 80, 85, 86, 87, 88, 89, 90, 91, 92, 93, 94, 95, 96, 97, 98, 99 | | i. Classes of Pesticidal Proteins

The pesticidal proteins provided herein and the nucleotide sequences encoding them are useful in methods for impacting pests. That is, the compositions and methods of the invention find use in agriculture for controlling or killing pests, including pests of many crop plants. The pesticidal proteins provided herein are toxin proteins from bacteria and exhibit activity against certain pests. The pesticidal proteins are from several classes of toxins including Cry, Cyt, BIN, Mtx toxins. See, for example, Table 1 for the specific protein classifications of the various SEQ ID NOS provided herein. In addition, reference is made throughout this disclosure to Pfam database entries. The Pfam database is a database of protein families, each represented by multiple sequence alignments and a profile hidden Markov model. Finn et al. (2014) Nucl. Acid Res. Database Issue 42:D222-D230.

Bacillus thuringiensis (Bt) is a gram-positive bacterium that produces insecticidal proteins as crystal inclusions during its sporulation phase of growth. The proteinaceous inclusions of Bacillus thuringiensis (Bt) are called crystal proteins or δ-endotoxins (or Cry proteins), which are toxic to members of the class Insecta and other invertebrates. Similarly, Cyt proteins are parasporal inclusion proteins from Bt that exhibits hemolytic (Cytolitic) activity or has obvious sequence similarity to a known Cyt protein. These toxins are highly specific to their target organism, are innocuous to humans, vertebrates, and plants.

The structure of the Cry toxins reveals five conserved amino acid blocks, concentrated mainly in the center of the domain or at the junction between the domains. The Cry toxin consists of three domains, each with a specific function. Domain I is a seven α-helix bundle in which a central helix is completely surrounded by six outer helices. This domain is implicated in channel formation in the membrane. Domain II appears as a triangular column of three antiparallel β-sheets, which are similar to antigen-binding regions of immunoglobulins. Domain III contains antiparallel β-strands in a β sandwich form. The N-terminal part of the toxin protein is responsible for its toxicity and specificity and contains five conserved regions. The C-terminal part is usually highly conserved and probably responsible for crystal formation. See, for example, U.S. Pat. No. 8,878,007.

Strains of B. thuringiensis show a wide range of specificity against different insect orders (Lepidoptera, Diptera, Coleoptera, Hymenoptera, Homoptera, Phthiraptera or Mallophaga, and Acari) and other invertebrates (Nemathelminthes, Platyhelminthes, and Sarocomastebrates). The cry proteins have been classified into groups based on toxicity to various insect and invertebrate groups. Generally, Cry I demonstrates toxicity to lepidopterans, Cry II to lepidopterans and dipterans, CryIII to coleopterans, Cry IV to dipterans, and Cry V and Cry VI to nematodes. New Cry proteins can be identified and assigned to a Cry group based on amino acid identity. See, for example, Bravo, A. (1997) J. of Bacteria 179:2793-2801; Bravo et al. (2013) Microb. Biotechnol. 6:17-26, herein incorporated by reference.

Over 750 different cry gene sequences have been classified into 73 groups (Cry1-Cry73), with new members of this gene family continuing to be discovered (Crickmore et al. (2014) www.btnomenclature.info/). The cry gene family consists of several phylogentically non-related protein families that may have different modes of action: the family of three-domain Cry toxins, the family of mosquitocidal Cry toxins, the family of the binary-like toxins, and the Cyt family of toxins (Bravo et al., 2005). Some Bt strains produce additional insecticidal toxins, the VIP toxins. See, also, Cohen et al. (2011) J. Mol. Biol. 413:4-814; Crickmore et al. (2014) *Bacillus thuringiensis* toxin nomenclature, found on the world wide web at lifesci.sussex.ac.uk/home/Neil_Crickmore/Bt/; Crickmore et al. (1988) *Microbiol. Mol. Biol. Rev.* 62: 807-813; Gill et al. (1992) *Ann. Rev. Entomol.* 37: 807-636; Goldbert et al. (1997) *Appl. Environ. Microbiol.* 63:2716-2712; Knowles et al. (1992) *Proc. R. Soc. Ser. B.* 248: 1-7; Koni et al. (1994) *Microbiology* 140: 1869-1880; Lailak et al. (2013) *Biochem. Biophys. Res. Commun.* 435: 216-221; Lopez-Diaz et al. (2013) *Environ. Microbiol.* 15: 3030-3039; Perez et al. (2007) *Cell. Microbiol.* 9: 2931-2937; Promdonkoy et al. (2003) *Biochem. J.* 374: 255-259; Rigden (2009) *FEBS Lett.* 583: 1555-1560; Schnepf et al. (1998) *Microbiol. Mol. Biol. Rev.* 62: 775-806; Soberon et al. (2013) *Peptides* 41: 87-93; Thiery et al. (1998) *J. Am. Mosq. Control Assoc.* 14: 472-476; Thomas et al. (1983) FEBS Lett. 154: 362-368; Wirth et al. (1997) *Proc. Natl. Acad. Sci. U.S.A.* 94: 10536-10540; Wirth et al (2005) *Appl. Environ. Microbiol.* 71: 185-189; and, Zhang et al. (2006) *Biosci. Biotechnol. Biochem.* 70: 2199-2204; each of which is herein incorporated by reference in their entirety.

Cyt designates a parasporal crystal inclusion protein from *Bacillus thuringiensis* with cytolytic activity, or a protein with sequence similarity to a known Cyt protein. (Crickmore et al. (1998) *Microbiol. Mol. Biol. Rev.* 62: 807-813). The gene is denoted by cyt. These proteins are different in structure and activity from Cry proteins (Gill et al. (1992) *Annu. Rev. Entomol.* 37: 615-636). The Cyt toxins were first discovered in *B. thuringiensis* subspecies *israelensis* (Goldberg et al. (1977) *Mosq. News.* 37: 355-358). There are 3 Cyt toxin families including 11 holotype toxins in the current nomenclature (Crickmore et al. (2014) *Bacillus thuringiensis* toxin nomenclature found on the world wide web at lifesci.sussex.ac.uk/home/Neil_Crickmore/Bt/). The majority of the *B. thuringiensis* isolates with cyt genes show activity against dipteran insects (particularly mosquitoes and black flies), but there are also cyt genes that have been described in *B. thuringiensis* strains targeting lepidopteran or coleopteran insects (Guerchicoff et al. (1997) *Appl. Environ. Microbiol.* 63: 2716-2721).

The structure of Cyt2A, solved by X-ray crystallography, shows a single domain where two outer layers of α-helix wrap around a mixed β-sheet. Further available crystal structures of Cyt toxins support a conserved α-β structural model with two α-helix hairpins flanking a β-sheet core containing seven to eight β-strands. (Cohen et al. (2011) *J. Mol. Biol.* 413: 80 4-814) Mutagenic studies identified β-sheet residues as critical for toxicity, while mutations in the helical domains did not affect toxicity (Adang et al.; Diversity of *Bacillus thuringiensis* Crystal Toxins and Mechanism of Action. In: T. S. Dhadialla and S. S. Gill, eds, *Advances in Insect Physiology, Vol.* 47, Oxford: Academic Press, 2014, pp. 39-87.) The representative domain of the Cyt toxin is a δ-endotoxin, Bac_thur_toxin (Pfam PF01338).

There are multiple proposed models for the mode of action of Cyt toxins, and it is still an area of active investigation. Some Cyt proteins (Cyt1A) have been shown to require the presence of accessory proteins for crystallization. Cyt1A and Cyt2A protoxins are processed by digestive proteases at the same sites in the N- and C-termini to a stable toxin core. Cyt toxins then interact with non-saturated membrane lipids, such as phosphatidylcholine, phosphatidylethanolamine, and sphingomyelin. For Cyt toxins, pore-formation and detergent-like membrane disruption have been proposed as non-exclusive mechanisms; and it is generally accepted that both may occur depending on toxin concentration, with lower concentrations favoring oligomeric pores and higher concentrations leading to membrane breaks. (Butko (2003) *Appl. Environ. Microbiol.* 69: 2415-2422) In the pore-formation model, the Cyt toxin binds to the cell membrane, inducing the formation of cation-selective channels in the membrane vesicles leading to colloid-osmotic lysis of the cell. (Knowles et al. (1989) FEBS Lett. 244: 259-262; Knowles et al. (1992) *Proc. R. Soc. Ser. B.* 248: 1-7 and Promdonkoy et al. (2003) *Biochem. J.* 374: 255-259). In the detergent model, there is a nonspecific aggregation of the toxin on the surface of the lipid bilayer leading to membrane disassembly and cell death. (Butko (2003) supra; Manceva et al. (2005) *Biochem.* 44: 589-597).

Multiple studies have shown synergistic activity between Cyt toxins and other *B. thuringiensis* toxins, particularly the Cry, Bin, and Mtx toxins. This synergism has even been shown to overcome an insect's resistance to the other toxin. (Wirth 1997, Wirth 2005, Thiery 1998, Zhang 2006) The Cyt synergistic effect for Cry toxins is proposed to involve Cyt1A binding to domain II of Cry toxins in solution or on the membrane plane to promote formation of a Cry toxin pre-pore oligomer. Formation of this oligomer is independent of the Cyt oligomerization, binding or insertion. (Lailak 2013, Perez 2007, Lopez-Diaz 2013)

A number of pesticidal proteins unrelated to the Cry proteins are produced by some strains of *B. thuringiensis* and *B. cereus* during vegetative growth (Estruch et al. (1996) *Proc Natl Acad Sci USA* 93:5389-5394; Warren et al. (1994) WO 94/21795). These vegetative insecticidal proteins, or Vips, do not form parasporal crystal proteins and are apparently secreted from the cell. The Vips are presently excluded from the Cry protein nomenclature because they are not crystal-forming proteins. The term VIP is a misnomer in the sense that some *B. thuringiensis* Cry proteins are also produced during vegetative growth as well as during the stationary and sporulation phases, most notably Cry3Aa. The location of the Vip genes in the *B. thuringiensis* genome has been reported to reside on large plasmids that also encode cry genes (Mesrati et al. (2005) *FEMS Microbiol. Lett.* 244(2):353-8). A web-site for the nomenclature of Bt toxins can be found on the world wide web at lifesci.sussex.ac.uk with the path "/home/Neil_Crickmore/Bt/" and at: "btnomenclature.info/". See also, Schnepf et al. (1998) *Microbiol. Mol. Biol. Rev.* 62(3):775-806. Such references are herein incorporated by reference.

To date four categories of Vips have been identified. Some Vip genes form binary two-component protein complexes; an "A" component is usually the "active" portion, and a "B" component is usually the "binding" portion. (Pfam pfam.xfam.org/family/PF03495). The Vip1 and Vip4 proteins generally contain binary toxin B protein domains. Vip2 proteins generally contain binary toxin A protein domains.

The Vip1 and Vip2 proteins are the two components of a binary toxin that exhibits toxicity to coleopterans. Vip1Aa1 and Vip2Aa1 are very active against corn rootworms, particularly *Diabrotica virgifera* and *Diabrotica longicornis* (Han et al. (1999) *Nat. Struct. Biol.* 6:932-936; Warren G W (1997) "Vegetative insecticidal proteins: novel proteins for control of corn pests" In: Carozzi N B, Koziel M (eds) *Advances in insect control, the role of transgenic plants*; Taylor & Francis Ltd, London, pp 109-21). The membrane-binding 95 kDa Vip1 multimer provides a pathway for the 52 kDa vip2 ADP-ribosylase to enter the cytoplasm of target western corn rootworm cells (Warren (1997) supra). The NAD-dependent ADP-ribosyltransferase Vip2 likely modifies monomeric actin at Arg177 to block polymerization, leading to loss of the actin cytoskeleton and eventual cell death due to the rapid subunit ex-change within actin filaments in vivo (Carlier M. F. (1990) *Adv. Biophys.* 26:51-73).

Like Cry toxins, activated Vip3A toxins are pore-forming proteins capable of making stable ion channels in the membrane (Lee et al. (2003) *Appl. Environ. Microbiol.* 69:4648-4657). Vip3 proteins are active against several major lepidopteran pests (Rang et al. (2005) *Appl. Environ. Microbiol.* 71(10):6276-6281; Bhalla et al. (2005) *FEMS Microbiol. Lett.* 243:467-472; Estruch et al. (1998) WO 9844137; Estruch et al. (1996) *Proc Natl Acad Sci USA* 93:5389-5394; Selvapandiyan et al. (2001) *Appl. Environ Microbiol.* 67:5855-5858; Yu et al. (1997) *Appl. Environ Microbiol.* 63:532-536). Vip3A is active against *Agrotis ipsilon, Spodoptera frugiperda, Spodoptera exigua, Heliothis virescens*, and *Helicoverpa zea* (Warren et al. (1996) WO 96/10083; Estruch et al. (1996) *Proc Natl Acad Sci USA* 93:5389-5394). Like Cry toxins, Vip3A proteins must be activated by proteases prior to recognition at the surface of the midgut epithelium of specific membrane proteins different from those recognized by Cry toxins.

The MTX family of toxin proteins is characterized by the presence of a conserved domain, ETX_MTX2 (pfam 03318). Members of this family share sequence homology with the mosquitocidal toxins Mtx2 and Mtx3 from *Bacillus sphaericus*, as well as with the epsilon toxin ETX from *Clostridium perfringens* (Cole et al. (2004) *Nat. Struct. Mol. Biol.* 11: 797-8; Thanabalu et al. (1996) *Gene* 170:85-9). The MTX-like proteins are structurally distinct from the three-domain Cry toxins, as they have an elongated and predominately β-sheet-based structure. However, similar to the three-domain toxins, the MTX-like proteins are thought to form pores in the membranes of target cells (Adang et al. (2014) supra). Unlike the three-domain Cry proteins, the MTX-like proteins are much smaller in length, ranging from 267 amino acids (Cry23) to 340 amino acids (Cry15A.

To date, only 15 proteins belonging to the family of MTX-like toxins have been assigned Cry names, making this a relatively small class compared to the three-domain Cry family (Crickmore et al. (2014) supra; Adang et al. (2014) supra). The members of the MTX-like toxin family include Cry15, Cry23, Cry33, Cry38, Cry45, Cry46, Cry51, Cry60A, Cry60B, and Cry64. This family exhibits a range of insecticidal activity, including activity against insect pests of the Lepidopteran and Coleopteran orders. Some members of this family may form binary partnerships with other proteins, which may or may not be required for insecticidal activity.

Cry15 is a 34 kDA protein that was identified in *Bacillus thuringiensis* serovar thompsoni HD542; it occurs naturally in a crystal together with an unrelated protein of approximately 40 kDa. The gene encoding Cry15 and its partner protein are arranged together in an operon. Cry15 alone has been shown to have activity against lepidopteran insect pests including *Manduca sexta, Cydia pomonella*, and *Pieris rapae*, with the presence of the 40 kDA protein having been shown to increase activity of Cry15 only against *C. pomonella* (Brown K. and Whiteley H. (1992) *J. Bacteriol.* 174:549-557; Naimov et al. (2008) *Appl. Environ. Microbiol.* 74:7145-7151). Further studies are needed to elucidate the function of the partner protein of Cry15. Similarly, Cry23 is a 29 kDA protein that has been shown to have activity against the coleopteran pests *Tribolium castaneum* and *Popillia japonica* together with its partner protein Cry37 (Donovan et al. (2000) U.S. Pat. No. 6,063,756).

New members of the MTX-like family are continuing to be identified. An ETX_MTX toxin gene was recently identified in the genome of *Bacillus thuringiensis* serovar tolworthi strain Na205-3. This strain was found to be toxic against the lepidpoteran pest *Helicoverpa armigera*, and it also contained homologs of Cry1, Cry11, Vip1, Vip2, and Vip3 (Palma et al. (2014) *Genome Announc.* 2(2): e00187-14. Published online Mar. 13, 2014 at doi: 10.1128/genomeA.00187-14; PMCID: PMC3953196). Because the MTX-like proteins have a unique domain structure relative to the three-domain Cry proteins, they are believed to possess a unique mode of action, thereby making them a valuable tool in insect control and the fight against insect resistance. Bacterial cells produce large numbers of toxins with diverse specificity against host and non-host organisms. Large families of binary toxins have been identified in numerous bacterial families, including toxins that have activity against insect pests. (Poopathi and Abidha (2010) *J. Physiol. Path.* 1(3): 22-38). *Lysinibacillus sphaericus* (Ls), formerly *Bacillus sphaericus*, (Ahmed et al. (2007) *Int. J. Syst. Evol. Microbiol.* 57:1117-1125) is well-known as an insect biocontrol strain. Ls produces several insecticidal proteins, including the highly potent binary complex BinA/BinB. This binary complex forms a parasporal crystal in Ls cells and has strong and specific activity against dipteran insects, specifically mosquitoes. In some areas, insect resistance to existing Ls mosquitocidal strains has been reported. The discovery of new binary toxins with different target specificity or the ability to overcome insect resistance is of significant interest.

The Ls binary insecticidal protein complex contains two major polypeptides, a 42 kDa polypeptide and a 51 kDa polypeptide, designated BinA and BinB, respectively (Ahmed et al. (2007) supra). The two polypeptides act synergistically to confer toxicity to their targets. Mode of action involves binding of the proteins to receptors in the larval midgut. In some cases, the proteins are modified by protease digestion in the larval gut to produce activated forms. The BinB component is thought to be involved in binding, while the BinA component confers toxicity (Nielsen-LeRoux et al. (2001) *Appl. Environ. Microbiol.* 67(11):5049-5054). When cloned and expressed separately, the BinA component is toxic to mosquito larvae, while the BinB component is not. However, co-administration of the proteins markedly increases toxicity (Nielsen-LeRoux et al. (2001) supra).

A small number of Bin protein homologs have been described from bacterial sources. Priest et al. (1997) *Appl. Environ. Microbiol.* 63(4):1195-1198 describe a hybridization effort to identify new Ls strains, although most of the genes they identified encoded proteins identical to the known BinA/BinB proteins. The BinA protein contains a defined conserved domain known as the Toxin 10 superfamily domain. This toxin domain was originally defined by its presence in BinA and BinB. The two proteins both have the domain, although the sequence similarity between BinA and BinB is limited in this region (<40%). The Cry49Aa protein, which also has insecticidal activity, also has this domain (described below).

The Cry48Aa/Cry49Aa binary toxin of Ls has the ability to kill *Culex quinquefasciatus* mosquito larvae. These proteins are in a protein structural class that has some similarity to the Cry protein complex of *Bacillus thuringiensis* (Bt), a well-known insecticidal protein family. The Cry34/Cry35 binary toxin of Bt is also known to kill insects, including Western corn rootworm, a significant pest of corn. Cry34, of which several variants have been identified, is a small (14 kDa) polypeptide, while Cry35 (also encoded by several variants) is a 44 kDa polypeptide. These proteins have some sequence homology with the BinA/BinB protein group and are thought to be evolutionarily related (Ellis et al. (2002) *Appl. Environ. Microbiol.* 68(3):1137-1145).

Phosphoinositide phospholipase C proteins (PI-PLC; also phosphotidylinositol phospholipase C) are members of the broader group of phospholipase C proteins. Many of these proteins play important roles in signal transduction as part of normal cell physiology. Several important bacterial toxins also contain domains with similarity to these proteins (Titball, R. W. (1993) *Microbiological Reviews.* 57(2):347-366). Importantly, these proteins are implicated in signal amplification during intoxication of insect cells by Bt Cry proteins (Valaitis, A. P. (2008) *Insect Biochemistry and Molecular Biology.* 38: 611-618).

The PI-PLC toxin class occurs in *Bacillus* isolates, commonly seen in co-occurrence with homologs to other described toxin classes, such as Binary Toxins. This class of sequences has homology to phosphatidylinositol phosphodiesterases (also referred to as phosphatidylinositol-specific phospholipase C—PI-PLC). The crystal structure and its active site were solved for *B. cereus* PI-PLC by Heinz et al (Heinz, et. al., (1995) *The EMBO Journal.* 14(16): 3855-3863). The roles of the *B. cereus* PI-PLC active site amino acid residues in catalysis and substrate binding were investigated by Gässler et al using site-directed mutagenesis, kinetics, and crystal structure analysis (Gässler, et. al., (1997) *Biochemistry.* 36(42):12802-13).

These PI-PLC toxin proteins contain a PLC-like phosphodiesterase, TIM beta/alpha-barrel domain (IPR017946) and/or a Phospholipase C, phosphatidylinositol-specific, X domain (IPR000909) (also referred to as the PI-PLC X-box domain). We have also seen proteins with these domains in combination with other typical *Bacillus* protein toxin domains. This list includes most commonly a lectin domain (IPR000772), a sugar-binding domain that can be present in one or more copies and is thought to bind cell membranes, as well as the Insecticidal crystal toxin (IPR008872) (also referred to as Toxin10 or P42), which is the defining domain of the Binary Toxin.

Previously, toxins of this PI-PLC class were defined in U.S. Pat. No. 8,318,900 B2 SEQ ID NOs 30 (DNA) and 79 (amino acid), in U.S. Patent Publication No. 20110263488A1 SEQ ID NOs 8 (DNA) and 9 (amino acid), and in U.S. Pat. No. 8,461,421B2 SEQ ID NOs 3 (DNA) and 63 (amino acid).

Provided herein are pesticidal proteins from these classes of toxins. The pesticidal proteins are classified by their structure, homology to known toxins and/or their pesticidal specificity. Table 2 provides the PFAM domains present in some of the recited SEQ ID NOS.

Further provided are APG01037.1 is set forth in SEQ ID NO:209 and it is a fragment of SEQ ID NO: 208 (APG01037); shares 98% sequence identity to SEQ ID NO: 207 (APG00623); shares 96% sequence identity to SEQ ID NO: 206 (APG00556.1); and shares 96% sequence identity to SEQ ID NO: 205 (APG00556).

TABLE 2

PFAM domains

| APG ID | Seq ID | Modification Type | PFAM domain | Domain Description | Domain positions Start | Stop |
|---|---|---|---|---|---|---|
| APG00326 | Seq ID 1 | | PF03945 | Endotoxin N | 87 | 332 |
| | | | PF00555 | Endotoxin M | 337 | 543 |
| | | | PF03944 | Endotoxin C | 553 | 697 |
| APG00326 modified | Seq ID 2 | Alternate start | PF03945 | Endotoxin N | 70 | 315 |
| | | | PF00555 | Endotoxin M | 320 | 526 |
| | | | PF03944 | Endotoxin C | 536 | 680 |
| APG00326 modified | Seq ID 3 | Alternate start and 3' Truncation | PF03945 | Endotoxin N | 70 | 315 |
| | | | PF00555 | Endotoxin M | 320 | 526 |
| | | | PF03944 | Endotoxin C | 536 | 679 |
| APG00343 | Seq ID 4 | | PF03945 | Endotoxin N | 84 | 307 |
| | | | PF00555 | Endotoxin M | 312 | 530 |
| | | | PF03944 | Endotoxin C | 540 | 677 |
| APG00343 modified | Seq ID 5 | Alternate start | PF03945 | Endotoxin N | 72 | 295 |
| | | | PF00555 | Endotoxin M | 300 | 518 |
| | | | PF03944 | Endotoxin C | 528 | 665 |
| APG00383 | Seq ID 6 | | PF03945 | Endotoxin N | 78 | 329 |
| | | | PF03944 | Endotoxin C | 557 | 717 |
| APG00383 modified | Seq ID 7 | 3' Truncation | PF03945 | Endotoxin N | 78 | 329 |
| | | | PF03944 | Endotoxin C | 557 | 716 |
| APG00493 | Seq ID 8 | | no PFAM domains | | | |
| APG00493 modified | Seq ID 9 | Alternate start | no PFAM domains | | | |
| APG00494 | Seq ID 10 | | PF14200 | Ricin B Lectin 2 | 48 | 150 |
| | | | PF05431 | Toxin 10 | 156 | 353 |
| APG00494 modified | Seq ID 11 | Alternate start | PF14200 | Ricin B Lectin 2 | 44 | 145 |
| | | | PF05431 | Toxin 10 | 152 | 349 |
| APG00495 | Seq ID 12 | | PF03318 | ETX MTX2 | 50 | 310 |
| APG00495 modified | Seq ID 13 | Signal peptide removed | PF03318 | ETX MTX2 | 8 | 267 |
| APG00513 | Seq ID 14 | | PF03318 | ETX MTX2 | 80 | 326 |
| APG00514 | Seq ID 15 | | PF03945 | Endotoxin N | 84 | 307 |
| | | | PF00555 | Endotoxin M | 312 | 530 |
| | | | PF03944 | Endotoxin C | 540 | 677 |

TABLE 2-continued

| | | | PFAM domains | | | |
|---|---|---|---|---|---|---|
| | | | | | Domain positions | |
| APG ID | Seq ID | Modification Type | PFAM domain | Domain Description | Start | Stop |
| APG00514 modified | Seq ID 16 | Alternate start | PF03945 | Endotoxin N | 72 | 295 |
| | | | PF00555 | Endotoxin M | 300 | 518 |
| | | | PF03944 | Endotoxin C | 528 | 665 |
| APG00524 | Seq ID 17 | | PF03945 | Endotoxin N | 66 | 316 |
| | | | PF00555 | Endotoxin M | 321 | 523 |
| | | | PF03944 | Endotoxin C | 541 | 681 |
| APG00524 modified | Seq ID 18 | Alternate start and 3' Truncation | PF03945 | Endotoxin N | 66 | 316 |
| | | | PF00555 | Endotoxin M | 321 | 523 |
| | | | PF03944 | Endotoxin C | 541 | 680 |
| APG00524 modified | Seq ID 19 | Alternate start | PF03945 | Endotoxin N | 66 | 316 |
| | | | PF00555 | Endotoxin M | 321 | 523 |
| | | | PF03944 | Endotoxin C | 541 | 681 |
| APG00528 | Seq ID 20 | | no PFAM domains | | | |
| APG00533 | Seq ID 21 | | PF03945 | Endotoxin N | 37 | 232 |
| APG00534 | Seq ID 22 | | PF03945 | Endotoxin N | 53 | 259 |
| | | | PF03945 | Endotoxin N | 290 | 331 |
| | | | PF00555 | Endotoxin M | 338 | 544 |
| | | | PF03944 | Endotoxin C | 554 | 693 |
| APG00534 modified | Seq ID 23 | 3' Truncation | PF03945 | Endotoxin N | 53 | 259 |
| | | | PF03945 | Endotoxin N | 290 | 331 |
| | | | PF00555 | Endotoxin M | 338 | 544 |
| | | | PF03944 | Endotoxin C | 554 | 692 |
| APG00536 | Seq ID 24 | | PF03945 | Endotoxin N | 103 | 336 |
| | | | PF00555 | Endotoxin M | 341 | 552 |
| | | | PF03944 | Endotoxin C | 562 | 691 |
| | | | PF14200 | Ricin B Lectin 2 | 731 | 833 |
| APG00536 modified | Seq ID 25 | Alternate start and 3' Truncation | PF03945 | Endotoxin N | 56 | 289 |
| | | | PF00555 | Endotoxin M | 294 | 505 |
| | | | PF03944 | Endotoxin C | 515 | 644 |
| APG00536 modified | Seq ID 26 | Alternate start | PF03945 | Endotoxin N | 56 | 289 |
| | | | PF00555 | Endotoxin M | 294 | 505 |
| | | | PF03944 | Endotoxin C | 515 | 644 |
| | | | PF14200 | Ricin B Lectin 2 | 684 | 786 |
| APG00537 | Seq ID 27 | | PF03945 | Endotoxin N | 72 | 296 |
| | | | PF00555 | Endotoxin M | 301 | 507 |
| | | | PF03944 | Endotoxin C | 517 | 655 |
| APG00537 modified | Seq ID 28 | Alternate start | PF03945 | Endotoxin N | 69 | 293 |
| | | | PF00555 | Endotoxin M | 298 | 504 |
| | | | PF03944 | Endotoxin C | 514 | 652 |
| APG00537 modified | Seq ID 29 | Alternate start and 3' Truncation | PF03945 | Endotoxin N | 69 | 293 |
| | | | PF00555 | Endotoxin M | 298 | 504 |
| | | | PF03944 | Endotoxin C | 514 | 651 |
| APG00537 Split-Cry C-term | Seq ID 30 | | no PFAM domains | | | |
| APG00543 | Seq ID 31 | | PF03945 | Endotoxin N | 76 | 304 |
| | | | PF03944 | Endotoxin C | 523 | 682 |
| APG00543 modified | Seq ID 32 | 3' Truncation | PF03945 | Endotoxin N | 76 | 304 |
| | | | PF03944 | Endotoxin C | 523 | 681 |
| APG00555 | Seq ID 33 | | PF03945 | Endotoxin N | 80 | 300 |
| | | | PF00555 | Endotoxin M | 305 | 515 |
| | | | PF03944 | Endotoxin C | 525 | 659 |
| APG00555 modified | Seq ID 34 | Alternate start | PF03945 | Endotoxin N | 77 | 297 |
| | | | PF00555 | Endotoxin M | 302 | 512. |
| | | | PF03944 | Endotoxin C | 522 | 656 |
| APG00555 modified | Seq ID 35 | Alternate start and 3' Truncation | PF03945 | Endotoxin N | 77 | 297 |
| | | | PF00555 | Endotoxin M | 302 | 512 |
| | | | PF03944 | Endotoxin C | 522 | 655 |
| APG00557 | Seq ID 36 | | PF05431 | Toxin 10 | 210 | 404 |
| APG00557 modified | Seq ID 37 | Alternate start | PF05431 | Toxin 10 | 201 | 395 |
| APG00558 | Seq ID 38 | | PF03945 | Endotoxin N | 75 | 297 |
| | | | PF00555 | Endotoxin M | 302 | 521 |
| | | | PF03944 | Endotoxin C | 531 | 664 |
| APG00558 modified | Seq ID 39 | Alternate start | PF03945 | Endotoxin N | 75 | 297 |
| | | | PF00555 | Endotoxin M | 302 | 521 |
| | | | PF03944 | Endotoxin C | 531 | 664 |
| APG00558 modified | Seq ID 40 | Alternate start and 3' Truncation | PF03945 | Endotoxin N | 75 | 297 |
| | | | PF00555 | Endotoxin M | 302 | 521 |
| | | | PF03944 | Endotoxin C | 531 | 663 |

TABLE 2-continued

PFAM domains

| APG ID | Seq ID | Modification Type | PFAM domain | Domain Description | Domain positions Start | Stop |
|---|---|---|---|---|---|---|
| APG00565 | Seq ID 41 | | PF03945 | Endotoxin N | 85 | 321 |
| | | | PF00555 | Endotoxin M | 326 | 532 |
| | | | PF03944 | Endotoxin C | 542 | 691 |
| APG00565 modified | Seq ID 42 | Alternate start and 3' Truncation | PF03945 | Endotoxin N | 68 | 304 |
| | | | PF00555 | Endotoxin M | 309 | 515 |
| | | | PF03944 | Endotoxin C | 525 | 673 |
| APG00565 modified | Seq ID 43 | Alternate start | PF03945 | Endotoxin N | 68 | 304 |
| | | | PF00555 | Endotoxin M | 309 | 515 |
| | | | PF03944 | Endotoxin C | 525 | 674 |
| APG00566 | Seq ID 44 | | PF03318 | ETX MTX2 | 36 | 260 |
| APG00566 modified | Seq ID 45 | Alternate start | PF03318 | ETX MTX2 | 29 | 253 |
| APG00572 | Seq ID 46 | | PF00388 | PI-PLC-X | 334 | 472 |
| | | | PF14200 | Ricin B Lectin 2 | 760 | 866 |
| APG00587 | Seq ID 47 | | PF03945 | Endotoxin N | 111 | 312 |
| | | | PF14200 | Ricin B Lectin 2 | 433 | 540 |
| | | | PF02839 | CBM 5 12 | 557 | 593 |
| APG00587 modified | Seq ID 48 | Signal peptide removed | PF03945 | Endotoxin N | 73 | 274 |
| | | | PF14200 | Ricin B Lectin 2 | 395 | 502 |
| | | | PF02839 | CBM 5 12 | 519 | 555 |
| APG00939 | Seq ID 49 | | PF12495 | Vip3A N | 16 | 188 |
| | | | PF02018 | CBM 4 9 | 546 | 670 |
| | | | PF02018 | CBM 4 9 | 825 | 910 |
| APG00939 modified | Seq ID 50 | Alternate start | PF12495 | Vip3A N | 14 | 186 |
| | | | PF02018 | CBM 4 9 | 544 | 668 |
| | | | PF02018 | CBM 4 9 | 823 | 908 |
| APG00606 | Seq ID 51 | | PF03945 | Endotoxin N | 72 | 296 |
| | | | PF00555 | Endotoxin M | 301 | 507 |
| | | | PF03944 | Endotoxin C | 517 | 649 |
| APG00606 modified | Seq ID 52 | Alternate start and 3' Truncation | PF03945 | Endotoxin N | 69 | 293 |
| | | | PF00555 | Endotoxin M | 298 | 504 |
| | | | PF03944 | Endotoxin C | 514 | 645 |
| APG00606 modified | Seq ID 53 | Alternate start | PF03945 | Endotoxin N | 69 | 293 |
| | | | PF00555 | Endotoxin M | 298 | 504 |
| | | | PF03944 | Endotoxin C | 514 | 646 |
| APG00607 | Seq ID 54 | | PF03945 | Endotoxin N | 37 | 232 |
| APG00608 | Seq ID 55 | | PF03945 | Endotoxin N | 76 | 341 |
| | | | PF03944 | Endotoxin C | 572 | 727 |
| APG00608 modified | Seq ID 56 | 3' Truncation | PF03945 | Endotoxin N | 76 | 341 |
| | | | PF03944 | Endotoxin C | 572 | 726 |
| APG00609 | Seq ID 57 | | PF03318 | ETX MTX2 | 66 | 327 |
| APG00622 | Seq ID 58 | | PF03945 | Endotoxin N | 69 | 161 |
| | | | PF03945 | Endotoxin N | 188 | 335 |
| | | | PF03944 | Endotoxin C | 556 | 694 |
| APG00622 modified | Seq ID 59 | 3' Truncation | PF03945 | Endotoxin N | 69 | 161 |
| | | | PF03945 | Endotoxin N | 188 | 335 |
| | | | PF03944 | Endotoxin C | 556 | 693 |
| APG00624 | Seq ID 60 | | PF01338 | Bac thur toxin | 65 | 297 |
| | | | PF14200 | Ricin B Lectin 2 | 325 | 427 |
| | | | PF14200 | Ricin B Lectin 2 | 467 | 570 |
| APG00624 modified | Seq ID 61 | Alternate start | PF01338 | Bac thur toxin | 12 | 244 |
| | | | PF14200 | Ricin B Lectin 2 | 272 | 374 |
| | | | PF14200 | Ricin B Lectin 2 | 414 | 517 |
| APG00637 | Seq ID 62 | | PF03945 | Endotoxin N | 71 | 284 |
| | | | PF03945 | Endotoxin N | 290 | 360 |
| | | | PF00555 | Endotoxin M | 365 | 583 |
| | | | PF03944 | Endotoxin C | 593 | 725 |
| APG00637 modified | Seq ID 63 | Alternate start and 3' Truncation | PF03945 | Endotoxin N | 66 | 280 |
| | | | PF03945 | Endotoxin N | 284 | 355 |
| | | | PF00555 | Endotoxin M | 360 | 578 |
| | | | PF03944 | Endotoxin C | 588 | 719 |
| APG00637 modified | Seq ID 64 | Alternate start | PF03945 | Endotoxin N | 66 | 279 |
| | | | PF03945 | Endotoxin N | 285 | 355 |
| | | | PF00555 | Endotoxin M | 360 | 578 |
| | | | PF03944 | Endotoxin C | 588 | 720 |

TABLE 2-continued

| | | | PFAM domains | | | |
|---|---|---|---|---|---|---|
| | | | | | \multicolumn{2}{c}{Domain positions} |
| APG ID | Seq ID | Modification Type | PFAM domain | Domain Description | Start | Stop |
| APG00638 | Seq ID 65 | | PF00388 | PI-PLC-X | 78 | 204 |
| | | | PF14200 | Ricin B Lectin 2 | 391 | 493 |
| APG00641 | Seq ID 66 | | PF03318 | ETX MTX2 | 30 | 280 |
| APG00641 modified | Seq ID 67 | Alternate start | PF03318 | ETX MTX2 | 25 | 275 |
| APG00643 | Seq ID 68 | | PF03945 | Endotoxin N | 68 | 294 |
| | | | PF00555 | Endotoxin M | 299 | 506 |
| | | | PF03944 | Endotoxin C | 516 | 647 |
| APG00643 modified | Seq ID 69 | 3' Truncation | PF03945 | Endotoxin N | 68 | 294 |
| | | | PF00555 | Endotoxin M | 299 | 506 |
| | | | PF03944 | Endotoxin C | 516 | 646 |
| APG00644 | Seq ID 70 | | PF03945 | Endotoxin N | 98 | 294 |
| | | | PF01473 | CW binding 1 | 588 | 607 |
| | | | PF01473 | CW binding 1 | 612 | 627 |
| | | | PF01473 | CW binding 1 | 655 | 670 |
| | | | PF01473 | CW binding 1 | 816 | 831 |
| APG00644 modified | Seq ID 71 | Alternate start | PF03945 | Endotoxin N | 93 | 289 |
| | | | PF01473 | CW binding 1 | 583 | 602 |
| | | | PF01473 | CW binding 1 | 607 | 622 |
| | | | PF01473 | CW binding 1 | 650 | 665 |
| | | | PF01473 | CW binding 1 | 811 | 826 |
| APG00644 modified | Seq ID 72 | Signal peptide removed | PF03945 | Endotoxin N | 55 | 251 |
| | | | PF01473 | CW binding 1 | 545 | 564 |
| | | | PF01473 | CW binding 1 | 569 | 584 |
| | | | PF01473 | CW binding 1 | 612 | 627 |
| | | | PF01473 | CW binding 1 | 773 | 788 |
| APG00648 | Seq ID 73 | | PF05431 | Toxin 10 | 202 | 398 |
| APG00648 modified | Seq ID 74 | Signal peptide removed | PF05431 | Toxin 10 | 168 | 364 |
| APG00649 | Seq ID 75 | | PF00652 | Ricin B Lectin | 40 | 170 |
| | | | PF05431 | Toxin 10 | 181 | 380 |
| APG00649 modified | Seq ID 76 | Alternate start | PF00652 | Ricin B Lectin | 38 | 168 |
| | | | PF05431 | Toxin 10 | 179 | 378 |
| APG00651 | Seq ID 77 | | PF03945 | Endotoxin N | 65 | 315 |
| | | | PF00555 | Endotoxin M | 320 | 515 |
| | | | PF03944 | Endotoxin C | 533 | 673 |
| APG00651 modified | Seq ID 78 | 3' Truncation | PF03945 | Endotoxin N | 65 | 315 |
| | | | PF00555 | Endotoxin M | 320 | 515 |
| | | | PF03944 | Endotoxin C | 533 | 672 |
| APG00657 | Seq ID 79 | | PF12495 | Vip3A N | 16 | 188 |
| | | | PF02018 | CBM 4 9 | 814 | 914 |
| APG00657 modified | Seq ID 80 | Alternate start | PF12495 | Vip3A N | 14 | 186 |
| | | | PF02018 | CBM 4 9 | 812 | 912 |
| APG00659 | Seq ID 81 | | no PFAM domains | | | |
| APG00659 modified | Seq ID 82 | Alternate start | no PFAM domains | | | |
| APG00661 | Seq ID 83 | | no PFAM domains | | | |
| APG00662 | Seq ID 84 | | PF03945 | Endotoxin N | 70 | 293 |
| | | | PF00555 | Endotoxin M | 298 | 504 |
| | | | PF03944 | Endotoxin C | 515 | 651 |
| APG00662 modified | Seq ID 85 | Alternate start | PF03945 | Endotoxin N | 61 | 284 |
| | | | PF00555 | Endotoxin M | 289 | 495 |
| | | | PF03944 | Endotoxin C | 506 | 642 |
| APG00662 modified | Seq ID 86 | Alternate start and 3' Truncation | PF03945 | Endotoxin N | 61 | 284 |
| | | | PF00555 | Endotoxin M | 289 | 495 |
| | | | PF03944 | Endotoxin C | 506 | 641 |
| APG00663 | Seq ID 87 | | PF03945 | Endotoxin N | 70 | 318 |
| | | | PF03944 | Endotoxin C | 537 | 687 |
| APG00663 modified | Seq ID 88 | 3' Truncation | PF03945 | Endotoxin N | 70 | 318 |
| | | | PF03944 | Endotoxin C | 537 | 686 |
| APG00664 | Seq ID 89 | | PF03945 | Endotoxin N | 74 | 325 |
| | | | PF00555 | Endotoxin M | 332 | 531 |
| | | | PF03944 | Endotoxin C | 541 | 687 |
| APG00664 modified | Seq ID 90 | 3' Truncation | PF03945 | Endotoxin N | 74 | 325 |
| | | | PF00555 | Endotoxin M | 332 | 531 |
| | | | PF03944 | Endotoxin C | 541 | 686 |

TABLE 2-continued

PFAM domains

| APG ID | Seq ID | Modification Type | PFAM domain | Domain Description | Domain positions Start | Stop |
|---|---|---|---|---|---|---|
| APG00672 | Seq ID 91 | | PF03945 | Endotoxin N | 98 | 335 |
| | | | PF03944 | Endotoxin C | 526 | 661 |
| | | | PF01473 | CW binding 1 | 685 | 702 |
| | | | PF01473 | CW binding 1 | 714 | 731 |
| | | | PF01473 | CW binding 1 | 743 | 760 |
| | | | PF01473 | CW binding 1 | 772 | 789 |
| | | | PF01473 | CW binding 1 | 801 | 818 |
| APG00672 modified | Seq ID 92 | 3' Truncation | PF03945 | Endotoxin N | 98 | 335 |
| | | | PF03944 | Endotoxin C | 526 | 660 |
| APG00673 | Seq ID 93 | | PF03945 | Endotoxin N | 92 | 331 |
| | | | PF00555 | Endotoxin M | 336 | 556 |
| | | | PF03944 | Endotoxin C | 567 | 719 |
| APG00673 modified | Seq ID 94 | Alternate start and 3' Truncation | PF03945 | Endotoxin N | 62 | 302 |
| | | | PF00555 | Endotoxin M | 307 | 527 |
| | | | PF03944 | Endotoxin C | 538 | 689 |
| APG00673 modified | Seq ID 95 | Alternate start | PF03945 | Endotoxin N | 63 | 302 |
| | | | PF00555 | Endotoxin M | 307 | 527 |
| | | | PF03944 | Endotoxin C | 538 | 690 |
| APG00674 | Seq ID 96 | | PF00652 | Ricin B Lectin | 8 | 143 |
| | | | PF05431 | Toxin 10 | 152 | 349 |
| APG00675 | Seq ID 97 | | PF12495 | Vip3A N | 10 | 187 |
| APG00677 | Seq ID 98 | | PF03945 | Endotoxin N | 66 | 299 |
| | | | PF00555 | Endotoxin M | 304 | 505 |
| | | | PF03944 | Endotoxin C | 515 | 651 |
| APG00679 | Seq ID 99 | | PF03945 | Endotoxin N | 35 | 253 |
| | | | PF00555 | Endotoxin M | 258 | 450 |
| | | | PF03944 | Endotoxin C | 460 | 594 |
| APG00679 modified | Seq ID 100 | 3' Truncation | PF03945 | Endotoxin N | 35 | 253 |
| | | | PF00555 | Endotoxin M | 258 | 450 |
| | | | PF03944 | Endotoxin C | 460 | 593 |
| APG00687 | Seq ID 101 | | PF03945 | Endotoxin N | 59 | 322 |
| | | | PF00555 | Endotoxin M | 330 | 489 |
| | | | PF03944 | Endotoxin C | 530 | 667 |
| APG00687 modified | Seq ID 102 | 3' Truncation | PF03945 | Endotoxin N | 59 | 322 |
| | | | PF00555 | Endotoxin M | 330 | 490 |
| | | | PF03944 | Endotoxin C | 530 | 666 |
| APG00687 CryBP1 | Seq ID 103 | | PF07029 | CryBP1 | 1 | 119 |
| APG00688 | Seq ID 104 | | PF03945 | Endotoxin N | 65 | 300 |
| | | | PF00555 | Endotoxin M | 305 | 517 |
| | | | PF03944 | Endotoxin C | 527 | 665 |
| APG00688 modified | Seq ID 105 | 3' Truncation | PF03945 | Endotoxin N | 65 | 300 |
| | | | PF00555 | Endotoxin M | 305 | 517 |
| | | | PF03944 | Endotoxin C | 527 | 664 |
| APG00693 | Seq ID 106 | | PF03318 | ETX MTX2 | 91 | 318 |
| APG00693 modified | Seq ID 107 | Signal peptide removed | PF03318 | ETX MTX2 | 12 | 268 |
| APG00693 modified | Seq ID 108 | Alternate start | PF03318 | ETX MTX2 | 35 | 294 |
| APG00695 | Seq ID 109 | | PF03945 | Endotoxin N | 61 | 295 |
| | | | PF00555 | Endotoxin M | 300 | 494 |
| | | | PF03944 | Endotoxin C | 504 | 631 |
| APG00695 modified | Seq ID 110 | Alternate start and 3' Truncation | PF03945 | Endotoxin N | 58 | 292 |
| | | | PF00555 | Endotoxin M | 297 | 491 |
| | | | PF03944 | Endotoxin C | 501 | 627 |
| APG00695 modified | Seq ID 111 | Alternate start | PF03945 | Endotoxin N | 58 | 292 |
| | | | PF00555 | Endotoxin M | 297 | 491 |
| | | | PF03944 | Endotoxin C | 501 | 628 |
| APG00695 Split-Cry C-term | Seq ID 112 | | no PFAM domains | | | |
| APG00701 | Seq ID 113 | | PF05431 | Toxin 10 | 189 | 382 |
| APG00701 modified | Seq ID 114 | Signal peptide removed | PF05431 | Toxin 10 | 160 | 353 |
| APG00702 | Seq ID 115 | | PF03945 | Endotoxin N | 109 | 309 |
| | | | PF14200 | Ricin B Lectin 2 | 487 | 589 |
| APG00702 modified | Seq ID 116 | Signal peptide removed | PF03945 | Endotoxin N | 71 | 271 |
| | | | PF14200 | Ricin B Lectin 2 | 449 | 551 |
| APG00703 | Seq ID 117 | | PF03945 | Endotoxin N | 214 | 352 |
| | | | PF03944 | Endotoxin C | 573 | 723 |

TABLE 2-continued

| | | | PFAM domains | | | |
|---|---|---|---|---|---|---|
| | | | | | Domain positions | |
| APG ID | Seq ID | Modification Type | PFAM domain | Domain Description | Start | Stop |
| APG00703 modified | Seq ID 118 | Alternate start | PF03945 | Endotoxin N | 208 | 346 |
| | | | PF03944 | Endotoxin C | 567 | 717 |
| APG00703 modified | Seq ID 119 | Alternate start and 3' Truncation | PF03945 | Endotoxin N | 208 | 346 |
| | | | PF03944 | Endotoxin C | 567 | 716 |
| APG00705 | Seq ID 120 | | PF03945 | Endotoxin N | 100 | 343 |
| | | | PF03944 | Endotoxin C | 535 | 672 |
| APG00705 modified | Seq ID 121 | Alternate start | PF03945 | Endotoxin N | 94 | 337 |
| | | | PF03944 | Endotoxin C | 529 | 666 |
| APG00705 modified | Seq ID 122 | Signal peptide removed and 3' Truncation | PF03945 | Endotoxin N | 65 | 308 |
| | | | PF03944 | Endotoxin C | 500 | 636 |
| APG00705 modified | Seq ID 123 | Signal peptide removed | PF03945 | Endotoxin N | 65 | 308 |
| | | | PF03944 | Endotoxin C | 500 | 637 |
| APG00705 modified | Seq ID 124 | Alternate start and 3' Truncation | PF03945 | Endotoxin N | 94 | 337 |
| | | | PF03944 | Endotoxin C | 529 | 665 |
| APG00705 modified | Seq ID 125 | 3' Truncation | PF03945 | Endotoxin N | 100 | 343 |
| | | | PF03944 | Endotoxin C | 535 | 671 |
| APG00706 | Seq ID 126 | | PF05431 | Toxin 10 | 251 | 446 |
| APG00707 | Seq ID 127 | | PF03318 | ETX MTX2 | 20 | 277 |
| APG00707 modified | Seq ID 128 | Signal peptide removed | PF03318 | ETX MTX2 | 9 | 259 |
| APG00710 | Seq ID 129 | | PF03945 | Endotoxin N | 86 | 336 |
| | | | PF00555 | Endotoxin M | 343 | 533 |
| | | | PF03944 | Endotoxin C | 543 | 679 |
| APG00710 modified | Seq ID 130 | Alternate start | PF03945 | Endotoxin N | 63 | 313 |
| | | | PF00555 | Endotoxin M | 320 | 510 |
| | | | PF03944 | Endotoxin C | 520 | 656 |
| APG00710 modified | Seq ID 131 | Alternate start and 3' Truncation | PF03945 | Endotoxin N | 63 | 313 |
| | | | PF00555 | Endotoxin M | 320 | 510 |
| | | | PF03944 | Endotoxin C | 520 | 655 |
| APG00718 | Seq ID 132 | | PF03318 | ETX MTX2 | 34 | 292 |
| APG00721 | Seq ID 133 | | PF03945 | Endotoxin N | 37 | 270 |
| | | | PF03945 | Endotoxin N | 299 | 346 |
| | | | PF00555 | Endotoxin M | 351 | 462 |
| | | | PF03944 | Endotoxin C | 592 | 729 |
| APG00721 modified | Seq ID 134 | 3' Truncation | PF03945 | Endotoxin N | 37 | 270 |
| | | | PF03945 | Endotoxin N | 299 | 346 |
| | | | PF00555 | Endotoxin M | 351 | 463 |
| | | | PF03944 | Endotoxin C | 592 | 728 |
| APG00721 Split-Cry C-term | Seq ID 135 | | no PFAM domains | | | |
| APG00722 | Seq ID 136 | | PF14200 | Ricin B Lectin 2 | 45 | 146 |
| | | | PF05431 | Toxin 10 | 152 | 348 |
| APG00724 | Seq ID 137 | | PF05431 | Toxin 10 | 209 | 402 |
| APG00724 modified | Seq ID 138 | Signal peptide removed | PF05431 | Toxin 10 | 182 | 375 |
| APG00726 | Seq ID 139 | | PF03945 | Endotoxin N | 86 | 339 |
| | | | PF00555 | Endotoxin M | 350 | 559 |
| | | | PF03944 | Endotoxin C | 569 | 711 |
| APG00726 modified | Seq ID 140 | Alternate start | PF03945 | Endotoxin N | 72 | 325 |
| | | | PF00555 | Endotoxin M | 336 | 545 |
| | | | PF03944 | Endotoxin C | 555 | 697 |
| APG00726 modified | Seq ID 141 | Alternate start and 3' Truncation | PF03945 | Endotoxin N | 72 | 325 |
| | | | PF00555 | Endotoxin M | 336 | 545 |
| | | | PF03944 | Endotoxin C | 555 | 696 |
| APG00729 | Seq ID 142 | | PF05431 | Toxin 10 | 184 | 385 |
| APG00729 modified | Seq ID 143 | Signal peptide removed | PF05431 | Toxin 10 | 157 | 358 |
| APG00735 | Seq ID 144 | | PF14200 | Ricin B Lectin 2 | 69 | 172 |
| | | | PF05431 | Toxin 10 | 178 | 375 |
| APG00735 modified | Seq ID 145 | Alternate start | PF14200 | Ricin B Lectin 2 | 43 | 146 |
| | | | PF05431 | Toxin 10 | 152 | 349 |
| APG00781 | Seq ID 146 | | PF03945 | Endotoxin N | 59 | 294 |
| | | | PF00555 | Endotoxin M | 305 | 509 |
| | | | PF03944 | Endotoxin C | 519 | 656 |
| | | | PF00652 | Ricin B Lectin | 672 | 801 |

TABLE 2-continued

PFAM domains

| APG ID | Seq ID | Modification Type | PFAM domain | Domain Description | Domain positions Start | Stop |
|---|---|---|---|---|---|---|
| APG00781 modified | Seq ID 147 | 3' Truncation | PF03945 | Endotoxin N | 59 | 294 |
| | | | PF00555 | Endotoxin M | 305 | 509 |
| | | | PF03944 | Endotoxin C | 519 | 652 |
| APG00784 | Seq ID 148 | | PF03945 | Endotoxin N | 67 | 316 |
| | | | PF03944 | Endotoxin C | 531 | 673 |
| APG00784 modified | Seq ID 149 | 3' Truncation | PF03945 | Endotoxin N | 67 | 316 |
| | | | PF03944 | Endotoxin C | 531 | 672 |
| APG00785 | Seq ID 150 | | PF03945 | Endotoxin N | 72 | 302 |
| | | | PF00555 | Endotoxin M | 314 | 501 |
| | | | PF03944 | Endotoxin C | 511 | 670 |
| APG00785 modified | Seq ID 151 | Alternate start | PF03945 | Endotoxin N | 69 | 299 |
| | | | PF00555 | Endotoxin M | 311 | 498 |
| | | | PF03944 | Endotoxin C | 508 | 667 |
| APG00785 modified | Seq ID 152 | Alternate start and 3' Truncation | PF03945 | Endotoxin N | 69 | 299 |
| | | | PF00555 | Endotoxin M | 311 | 498 |
| | | | PF03944 | Endotoxin C | 508 | 666 |
| APG00786 | Seq ID 153 | | PF03945 | Endotoxin N | 67 | 288 |
| | | | PF00555 | Endotoxin M | 293 | 505 |
| | | | PF03944 | Endotoxin C | 516 | 653 |
| APG00786 modified | Seq ID 154 | Alternate start and 3' Truncation | PF03945 | Endotoxin N | 61 | 282 |
| | | | PF00555 | Endotoxin M | 287 | 499 |
| | | | PF03944 | Endotoxin C | 510 | 646 |
| APG00786 modified | Seq ID 155 | Alternate start | PF03945 | Endotoxin N | 61 | 282 |
| | | | PF00555 | Endotoxin M | 287 | 499 |
| | | | PF03944 | Endotoxin C | 510 | 647 |
| APG00787 | Seq ID 156 | | PF03945 | Endotoxin N | 110 | 311 |
| | | | PF01473 | CW binding 1 | 534 | 550 |
| APG00787 modified | Seq ID 157 | Signal peptide removed | PF03945 | Endotoxin N | 72 | 274 |
| | | | PF01473 | CW binding 1 | 496 | 512 |
| APG00799 | Seq ID 158 | | PF03945 | Endotoxin N | 63 | 260 |
| | | | PF03944 | Endotoxin C | 463 | 630 |
| APG00799 modified | Seq ID 159 | 3' Truncation | PF03945 | Endotoxin N | 63 | 260 |
| | | | PF03944 | Endotoxin C | 463 | 629 |
| APG00801 | Seq ID 160 | | PF03945 | Endotoxin N | 67 | 316 |
| | | | PF03944 | Endotoxin C | 527 | 666 |
| APG00801 modified | Seq ID 161 | 3' Truncation | PF03945 | Endotoxin N | 67 | 316 |
| | | | PF03944 | Endotoxin C | 527 | 665 |
| APG00802 | Seq ID 162 | | PF03945 | Endotoxin N | 65 | 285 |
| | | | PF00555 | Endotoxin M | 295 | 498 |
| | | | PF03944 | Endotoxin C | 508 | 653 |
| APG00802 modified | Seq ID 163 | 3' Truncation | PF03945 | Endotoxin N | 65 | 285 |
| | | | PF00555 | Endotoxin M | 295 | 498 |
| | | | PF03944 | Endotoxin C | 508 | 652 |
| APG00805 | Seq ID 164 | | PF03945 | Endotoxin N | 75 | 296 |
| | | | PF00555 | Endotoxin M | 301 | 500 |
| | | | PF03944 | Endotoxin C | 511 | 643 |
| APG00805 modified | Seq ID 165 | Alternate start and 3' Truncation | PF03945 | Endotoxin N | 72 | 293 |
| | | | PF00555 | Endotoxin M | 298 | 497 |
| | | | PF03944 | Endotoxin C | 508 | 639 |
| APG00805 modified | Seq ID 166 | Alternate start | PF03945 | Endotoxin N | 72 | 293 |
| | | | PF00555 | Endotoxin M | 298 | 497 |
| | | | PF03944 | Endotoxin C | 508 | 640 |
| APG00806 | Seq ID 167 | | PF05431 | Toxin 10 | 203 | 396 |
| APG00806 modified | Seq ID 168 | Signal peptide removed | PF00652 | Ricin B Lectin | 5 | 100 |
| | | | PF05431 | Toxin 10 | 174 | 367 |
| APG00807 | Seq ID 169 | | PF03318 | ETX MTX2 | 32 | 278 |
| APG00807 modified | Seq ID 170 | Alternate start | PF03318 | ETX MTX2 | 30 | 276 |
| APG00810 | Seq ID 171 | | PF03945 | Endotoxin N | 62 | 286 |
| | | | PF00555 | Endotoxin M | 291 | 489 |
| | | | PF03944 | Endotoxin C | 499 | 635 |
| APG00810 modified | Seq ID 172 | Alternate start and 3' Truncation | PF03945 | Endotoxin N | 59 | 283 |
| | | | PF00555 | Endotoxin M | 288 | 486 |
| | | | PF03944 | Endotoxin C | 496 | 631 |
| APG00810 modified | Seq ID 173 | Alternate start | PF03945 | Endotoxin N | 59 | 283 |
| | | | PF00555 | Endotoxin M | 288 | 486 |
| | | | PF03944 | Endotoxin C | 496 | 632 |
| APG00864 | Seq ID 174 | | PF03945 | Endotoxin N | 74 | 327 |
| | | | PF00555 | Endotoxin M | 332 | 526 |
| | | | PF03944 | Endotoxin C | 543 | 683 |

TABLE 2-continued

PFAM domains

| APG ID | Seq ID | Modification Type | PFAM domain | Domain Description | Domain positions Start | Stop |
|---|---|---|---|---|---|---|
| APG00912 | Seq ID 175 | | PF03945 | Endotoxin N | 70 | 308 |
| | | | PF00555 | Endotoxin M | 313 | 530 |
| | | | PF03944 | Endotoxin C | 540 | 678 |
| APG00912 modified | Seq ID 176 | Alternate start | PF03945 | Endotoxin N | 64 | 302 |
| | | | PF00555 | Endotoxin M | 307 | 524 |
| | | | PF03944 | Endotoxin C | 534 | 672 |
| APG00912 modified | Seq ID 177 | Alternate start and 3' Truncation | PF03945 | Endotoxin N | 64 | 302 |
| | | | PF00555 | Endotoxin M | 307 | 524 |
| | | | PF03944 | Endotoxin C | 534 | 671 |
| APG00912 CryBP1 | Seq ID 178 | | PF07029 | CryBP1 | 37 | 195 |
| APG00960 | Seq ID 179 | | PF03945 | Endotoxin N | 51 | 277 |
| | | | PF00555 | Endotoxin M | 282 | 491 |
| | | | PF03944 | Endotoxin C | 501 | 644 |
| APG00960 modified | Seq ID 180 | Alternate start and 3' Truncation | PF03945 | Endotoxin N | 36 | 262 |
| | | | PF00555 | Endotoxin M | 267 | 476 |
| | | | PF03944 | Endotoxin C | 486 | 628 |
| APG00960 modified | Seq ID 181 | Alternate start | PF03945 | Endotoxin N | 36 | 262 |
| | | | PF00555 | Endotoxin M | 267 | 476 |
| | | | PF03944 | Endotoxin C | 486 | 629 |
| APG00972 | Seq ID 182 | | PF03945 | Endotoxin N | 91 | 326 |
| | | | PF00555 | Endotoxin M | 332 | 540 |
| | | | PF03944 | Endotoxin C | 550 | 704 |
| APG00972 modified | Seq ID 183 | Alternate start and 3' Truncation | PF03945 | Endotoxin N | 68 | 303 |
| | | | PF00555 | Endotoxin M | 309 | 517 |
| | | | PF03944 | Endotoxin C | 527 | 680 |
| APG00972 modified | Seq ID 184 | Alternate start | PF03945 | Endotoxin N | 68 | 303 |
| | | | PF00555 | Endotoxin M | 309 | 517 |
| | | | PF03944 | Endotoxin C | 527 | 681 |
| APG00980 | Seq ID 185 | | PF03318 | ETX MTX2 | 94 | 315 |
| APG00980 modified | Seq ID 186 | Signal peptide removed | PF03318 | ETX MTX2 | 44 | 265 |
| APG00980 modified | Seq ID 187 | Alternate start | PF03318 | ETX MTX2 | 77 | 298 |
| APG00981 | Seq ID 188 | | PF03945 | Endotoxin N | 71 | 328 |
| | | | PF00555 | Endotoxin M | 333 | 525 |
| | | | PF03944 | Endotoxin C | 535 | 675 |
| APG00981 modified | Seq ID 189 | 3' Truncation | PF03945 | Endotoxin N | 71 | 328 |
| | | | PF00555 | Endotoxin M | 333 | 525 |
| | | | PF03944 | Endotoxin C | 535 | 674 |
| APG00986 | Seq ID 190 | | PF03945 | Endotoxin N | 76 | 305 |
| | | | PF00555 | Endotoxin M | 313 | 488 |
| | | | PF03944 | Endotoxin C | 499 | 635 |
| APG00986 modified | Seq ID 191 | Alternate start | PF03945 | Endotoxin N | 73 | 302 |
| | | | PF00555 | Endotoxin M | 310 | 485 |
| | | | PF03944 | Endotoxin C | 496 | 632 |
| APG00986 modified | Seq ID 192 | Alternate start and 3' Truncation | PF03945 | Endotoxin N | 73 | 302 |
| | | | PF00555 | Endotoxin M | 310 | 485 |
| | | | PF03944 | Endotoxin C | 496 | 631 |
| APG00986 Split-Cry C-term | Seq ID 193 | | no PFAM domains | | | |
| APG00988 | Seq ID 194 | | PF05431 | Toxin 10 | 190 | 386 |
| APG00988 modified | Seq ID 195 | Signal peptide removed | PF05431 | Toxin 10 | 163 | 359 |
| APG01000 | Seq ID 196 | | PF05431 | Toxin 10 | 57 | 251 |
| APG01000 modified | Seq ID 197 | Alternate start | PF05431 | Toxin 10 | 39 | 233 |
| APG01003 | Seq ID 198 | | PF12495 | Vip3A N | 16 | 188 |
| | | | PF02018 | CBM 4 9 | 545 | 666 |
| APG01003 modified | Seq ID 199 | Alternate start | PF12495 | Vip3A N | 14 | 186 |
| | | | PF02018 | CBM 4 9 | 543 | 664 |
| APG01028 | Seq ID 200 | | PF03945 | Endotoxin N | 80 | 310 |
| | | | PF00555 | Endotoxin M | 315 | 529 |
| | | | PF03944 | Endotoxin C | 539 | 671 |
| APG01028 modified | Seq ID 201 | Alternate start | PF03945 | Endotoxin N | 77 | 307 |
| | | | PF00555 | Endotoxin M | 312 | 526 |
| | | | PF03944 | Endotoxin C | 536 | 668 |
| APG01028 modified | Seq ID 202 | Alternate start and 3' Truncation | PF03945 | Endotoxin N | 77 | 307 |
| | | | PF00555 | Endotoxin M | 312 | 526 |
| | | | PF03944 | Endotoxin C | 536 | 667 |

TABLE 2-continued

PFAM domains

| APG ID | Seq ID | Modification Type | PFAM domain | Domain Description | Domain positions Start | Stop |
|---|---|---|---|---|---|---|
| APG01028 Split-Cry C-term | Seq ID 203 | | no PFAM domains | | | |
| APG01112 | Seq ID 204 | | PF03945 | Endotoxin N | 2 | 200 |
| APG00556 | Seq ID 205 | | no PFAM domains | | | |
| APG00556 modified | Seq ID 206 | Alternate start | no PFAM domains | | | |
| APG00623 | Seq ID 207 | | no PFAM domains | | | |
| APG01037 | Seq ID 208 | | no PFAM domains | | | |
| APG01037.1 (APG01037 modified) | Seq ID 209 | Alternate start | no PFAM domains | | | |
| APG01037.4 (APG01037 modified) | Seq ID 210 | Alternate start and point mutation (S to T) | no PFAM domains | | | |
| APG01037.5 (APG01037 modified) | Seq ID 211 | Alternate start and point mutation (S to T) | no PFAM domains | | | |
| APG01037.6 (APG01037 modified) | Seq ID 212 | Alternate start and point mutation (S to K) | no PFAM domains | | | |
| APG01037.7 (APG01037 modified) | Seq ID 213 | Alternate start and point mutation (T to E) | no PFAM domains | | | |
| APG01037.8 (APG01037 modified) | Seq ID 214 | Alternate start and point mutation (I to E) | no PFAM domains | | | |
| APG01086 | Seq ID 215 | | PF03318 | ETX MTX2 | 34 | 260 |
| APG01086 modified | Seq ID 216 | Alternate start | PF03318 | ETX MTX2 | 28 | 253 |
| APG06508 | Seq ID 217 | | no PFAM domains | | | |
| APG09801 | Seq ID 218 | | no PFAM domains | | | | ii. Variants and Fragments of Pesticidal Proteins and Polynucleotides Encoding the Same Pesticidal proteins or polypeptides of the invention include those set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218 and fragments and variants thereof. By "pesticidal toxin" or "pesticidal protein" or "pesticidal polypeptide" is intended a toxin or protein or polypeptide that has activity against one or more pests, including, insects, fungi, nematodes, and the like such that the pest is killed or controlled.

An "isolated" or "purified" polypeptide or protein, or biologically active portion thereof, is substantially or essentially free from components that normally accompany or interact with the polypeptide or protein as found in its naturally occurring environment. Thus, an isolated or purified polypeptide or protein is substantially free of other cellular material, or culture medium when produced by recombinant techniques, or substantially free of chemical precursors or other chemicals when chemically synthesized. A protein that is substantially free of cellular material includes preparations of protein having less than about 30%, 20%, 10%, 5%, or 1% (by dry weight) of contaminating protein. When the protein of the invention or biologically active portion thereof is recombinantly produced, optimally culture medium represents less than about 30%, 20%, 10%, 5%, or 1% (by dry weight) of chemical precursors or non-protein-of-interest chemicals.

The term "fragment" refers to a portion of a polypeptide sequence of the invention. "Fragments" or "biologically active portions" include polypeptides comprising a sufficient number of contiguous amino acid residues to retain the biological activity, i.e., have pesticidal activity. Fragments of the pesticidal proteins include those that are shorter than the full-length sequences, either due to the use of an alternate downstream start site, or due to processing that produces a shorter protein having pesticidal activity. Processing may occur in the organism the protein is expressed in, or in the pest after ingestion of the protein. Examples of fragments of the proteins can be found in Table 1. A biologically active portion of a pesticidal protein can be a polypeptide that is, for example, 10, 25, 50, 100, 150, 200, 250 or more amino acids in length of any one of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218. Such biologically active portions can be prepared by recombinant techniques and evaluated for pesticidal activity. As used here, a fragment comprises at least 8 contiguous amino acids of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218.

Bacterial genes, including those encoding the pesticidal proteins disclosed herein, quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present invention and may be used in the methods disclosed herein. It will be understood that, when expressed in plants, it will be necessary to alter the alternate start codon to ATG for proper translation.

In various embodiments the pesticidal proteins provided herein include amino acid sequences deduced from the full-length nucleotide sequences and amino acid sequences that are shorter than the full-length sequences due to the use of an alternate downstream start site. Thus, the nucleotide sequence of the invention and/or vectors, host cells, and plants comprising the nucleotide sequence of the invention (and methods of making and using the nucleotide sequence of the invention) may comprise a nucleotide sequence encoding an alternate start site.

It is recognized that modifications may be made to the pesticidal polypeptides provided herein creating variant proteins. Changes designed by man may be introduced through the application of site-directed mutagenesis techniques. Alternatively, native, as yet-unknown or as yet unidentified polynucleotides and/or polypeptides structurally and/or functionally-related to the sequences disclosed herein may also be identified that fall within the scope of the present invention. Conservative amino acid substitutions may be made in nonconserved regions that do not alter the function of the pesticidal proteins. Alternatively, modifications may be made that improve the activity of the toxin. Modification of Cry toxins by domain III swapping has resulted in some cases in hybrid toxins with improved toxicities against certain insect species. Thus, domain III swapping could be an effective strategy to improve toxicity of Cry toxins or to create novel hybrid toxins with toxicity against pests that show no susceptibility to the parental Cry toxins. Site-directed mutagenesis of domain II loop sequences may result in new toxins with increased insecticidal activity. Domain II loop regions are key binding regions of initial Cry toxins that are suitable targets for the mutagenesis and selection of Cry toxins with improved insecticidal properties. Domain I of the Cry toxin may be modified to introduce protease cleavage sites to improve activity against certain pests. Strategies for shuffling the three different domains among large numbers of cry genes and high through output bioassay screening methods may provide novel Cry toxins with improved or novel toxicities.

As indicated, fragments and variants of the polypeptides disclosed herein will retain pesticidal activity. Pesticidal activity comprises the ability of the composition to achieve an observable effect diminishing the occurrence or an activity of the target pest, including for example, bringing about death of at least one pest, or a noticeable reduction in pest growth, feeding, or normal physiological development. Such decreases in numbers, pest growth, feeding or normal development can comprise any statistically significant decrease, including, for example a decrease of about 5%, 10%, 15%, 20%, 25%, 30%, 35%, 40%, 45%, 50%, 55%, 60%, 65%, 70%, 75%, 85%, 90%, 95% or greater. The pesticidal activity against one or more of the various pests provided herein, including, for example, pesticidal activity against Coleoptera, Diptera, Hymenoptera, Lepidoptera, Mallophaga, Homoptera, Hemiptera, Orthroptera, Nematodes, Thysanoptera, Dermaptera, Isoptera, Anoplura, Siphonaptera, Trichoptera, etc., or any other pest described herein. It is recognized that the pesticidal activity may be different or improved relative to the activity of the native protein, or it may be unchanged, so long as pesticidal activity is retained. Methods for measuring pesticidal activity are provide elsewhere herein. See also, Czapla and Lang (1990) *J. Econ. Entomol.* 83:2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety.

By "variants" is intended polypeptides having an amino acid sequence that is at least about 60%, about 65%, about 70%, about 75%, about 80%, about 85%, about 86%, about 87%, about 88%, about 89%, about 90%, about 91%, about 92%, about 93%, about 94%, about 95%, about 96%, about 97%, about 98% or about 99% identical to the amino acid sequence of any of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218 and retain pesticidal activity. Note, Table 1 provides non-limiting examples of variant polypeptides (and polynucleotide encoding the same) for each of SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218. A biologically active variant of a pesticidal polypeptide of the invention may differ by as few as about 1-15 amino acid residues, as few as about 1-10, such as about 6-10, as few as 5, as few as 4, as few as 3, as few as 2, or as few as 1 amino acid residue. In specific embodiments, the polypeptides can comprise an N-terminal or a C-terminal truncation, which can comprise at least a deletion of 10, 15, 20, 25, 30, 35, 40, 45, 50 amino acids or more from either the N or C terminal of the polypeptide.

Recombinant or synthetic nucleic acids encoding the pesticidal polypeptides disclosed herein are also provided. Of particular interest are nucleic acid sequences that have been designed for expression in a plant of interest. That is, the nucleic acid sequence can be optimized for increased expression in a host plant. A pesticidal protein of the invention can be back-translated to produce a nucleic acid comprising codons optimized for expression in a particular host, for example, a crop plant. In another embodiment, the polynucleotides encoding the polypeptides provided herein may be optimized for increased expression in the transformed plant. That is, the polynucleotides can be synthesized using plant-preferred codons for improved expression. See, for example, Campbell and Gowri (1990) *Plant Physiol.* 92:1-11 for a discussion of host-preferred codon usage. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference. Expression of such a coding sequence by the transformed plant (e.g., dicot or monocot) will result in the production of a pesticidal polypeptide and confer increased resistance in the plant to a pest. Recombinant and synthetic nucleic acid molecules encoding the pesticidal proteins of the invention do not include the naturally occurring bacterial sequence encoding the protein.

A "recombinant polynucleotide" or "recombinant nucleic acid" comprises a combination of two or more chemically linked nucleic acid segments which are not found directly joined in nature. By "directly joined" is intended the two nucleic acid segments are immediately adjacent and joined to one another by a chemical linkage. In specific embodiments, the recombinant polynucleotide comprises a polynucleotide of interest or a variant or fragment thereof such that an additional chemically linked nucleic acid segment is located either 5', 3' or internal to the polynucleotide of interest. Alternatively, the chemically-linked nucleic acid segment of the recombinant polynucleotide can be formed by deletion of a sequence. The additional chemically linked nucleic acid segment or the sequence deleted to join the linked nucleic acid segments can be of any length, including for example, 1, 2, 3, 4, 5, 6, 7, 8, 9, 10, 15, 20 or greater nucleotides. Various methods for making such recombinant polynucleotides include chemical synthesis or by the manipulation of isolated segments of polynucleotides by genetic engineering techniques. In specific embodiments, the recombinant polynucleotide can comprise a recombinant DNA sequence or a recombinant RNA sequence. A "fragment of a recombinant polynucleotide or nucleic acid" comprises at least one of a combination of two or more chemically linked amino acid segments which are not found directly joined in nature.

Fragments of a polynucleotide (RNA or DNA) may encode protein fragments that retain activity. In specific embodiments, a fragment of a recombinant polynucleotide or a recombinant polynucleotide construct comprises at least one junction of the two or more chemically linked or operably linked nucleic acid segments which are not found directly joined in nature. A fragment of a polynucleotide that encodes a biologically active portion of a polypeptide that retains pesticidal activity will encode at least 25, 30, 40, 50, 60, 70, 75, 80, 90, 100, 110, 120, 125, 130, 140, 150, 160, 170, 175, 180, contiguous amino acids, or up to the total number of amino acids present in a full-length polypeptide as set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218. In specific embodiments, such polypeptide fragments are active fragment, and in still other embodiments, the polypeptide fragment comprises a recombinant polypeptide fragment. As used herein, a fragment of a recombinant polypeptide comprises at least one of a combination of two or more chemically linked amino acid segments which are not found directly joined in nature.

By "Variants" is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. As used herein, a "native" polynucleotide or polypeptide comprises a naturally occurring nucleotide sequence or amino acid sequence, respectively.

Variants of a particular polynucleotide of the invention (i.e., the reference polynucleotide) can also be evaluated by comparison of the percent sequence identity between the polypeptide encoded by a variant polynucleotide and the polypeptide encoded by the reference polynucleotide. Thus, for example, an isolated polynucleotide that encodes a polypeptide with a given percent sequence identity to the polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218 are disclosed. Percent sequence identity between any two polypeptides can be calculated using sequence alignment programs and parameters described elsewhere herein. Where any given pair of polynucleotides of the invention is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99% or more sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218.

Variant polynucleotide and proteins also encompass sequences and proteins derived from a mutagenic and recombinogenic procedure such as DNA shuffling. With such a procedure, one or more different pesticidal protein disclosed herein (SEQ ID NO: 1-218) is manipulated to create a new pesticidal protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the pesticidal sequences provided herein and other known pesticidal genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458. A "shuffled" nucleic acid is a nucleic acid produced by a shuffling procedure such as any shuffling procedure set forth herein. Shuffled nucleic acids are produced by recombining (physically or virtually) two or more nucleic acids (or character strings), for example in an artificial, and optionally recursive, fashion. Generally, one or more screening steps are used in shuffling processes to identify nucleic acids of interest; this screening step can be performed before or after any recombination step. In some (but not all) shuffling embodiments, it is desirable to perform multiple rounds of recombination prior to selection to increase the diversity of the pool to be screened. The overall process of recombination and selection are optionally repeated recursively. Depending on context, shuffling can refer to an overall process of recombination and selection, or, alternately, can simply refer to the recombinational portions of the overall process.

In one embodiment, a method of obtaining a polynucleotide that encodes an improved polypeptide comprising pesticidal activity is provided, wherein the improved polypeptide has at least one improved property over any one of SEQ ID NOS: 1-218. Such methods can comprises (a) recombining a plurality of parental polynucleotides to produce a library of recombinant polynucleotides encoding recombinant pesticidal polypeptides; (b) screening the library to identify a recombinant polynucleotide that encodes an improved recombinant pesticidal polypeptide that has an enhanced property improved over the parental polynucleotide; (c) recovering the recombinant polynucleotide that encodes the improved recombinant pesticidal polypeptide identified in (b); and, (d) repeating steps (a), (b) and (c) using the recombinant polynucleotide recovered in step (c) as one of the plurality of parental polynucleotides in repeated step (a).

Provided herein are active variants of the polypeptides set forth in SEQ ID NOS: 205, 206, 207, 208, 209, 210, 211, 212, 213, and/or 214. Such polypeptides comprise a sequence having at least 80%, 85%, 86%, 87%, 88%, 89%, 90%, 91%, 92%, 93%, 94%, 95%, 96%, 97%, 98%, or 99% sequence identity to any one of SEQ ID NOS: 205, 206, 207, 208, 209, 210, 211, 212, 213, and/or 214 and further comprises one or more of the modifications set forth in Table 3. Any given variant of SEQ ID NO: 205, 206, 207, 208, 209, 210, 211, 212, 213, and/or 214 can have one or more of any combination of amino acid alterations in the corresponding amino acid position(s) as set forth in Table 3, or fragments thereof. Such, variants will retain pesticidal activity. In specific embodiments, such variants will have improved pesticidal activity against an insect of interest.

Further provided are polypeptides comprising a sequence having at least 80%, 85%, 86%, 87%, 88%, 89%, 90%, 91%, 92%, 93%, 94%, 95%, 96%, 97%, 98%, or 99% sequence identity to any one of SEQ ID NOS: 205, 206, 207, 208, 209, 210, 211, 212, 213, and/or 214 and further comprise at least 1, 2, 3, 4, 5, 6, 7, 8, 9, 10 or more of the modifications set forth in Table 3, wherein the amino acid positions 204-210 corresponding to the positions of SEQ ID NO:208 (DHY-FWFL) are not altered.

Table 3 provides protein variants of any one of SEQ ID NO: 205-214 as indicated by amino acid position and change. The amino acid position denoted in Table 3 reflects the amino acid position of SEQ ID NO:208 (APG01037.0). Corresponding amino acid positions in SEQ ID NO: 205-207 and 209-214 can be determined using methods discussed elsewhere herein.

TABLE 3

| Gene name | AA position and change |
|---|---|
| APG01037.1 | K6L, V |
| APG01037.1 | F7T |
| APG01037.1 | S10T |
| APG01037.1 | E11D |
| APG01037.1 | V15L |
| APG01037.1 | G16D |
| APG01037.1 | N18T |
| APG01037.1 | P19T |
| APG01037.1 | N20D |
| APG01037.1 | F26D |
| APG01037.1. | E28D |
| APG01037.1 | R29L |
| APG01037.1 | F30Y |
| APG01037.1 | Y44F |
| APG01037.1 | Y45F |
| APG01037.1 | N46D |
| APG01037.1 | Q55R |
| APG01037.1 | T63M |
| APG01037.1 | E66P |
| APG01037.1 | T68I |
| APG01037.1 | Y69F |
| APG01037.1 | Q70R |
| APG01037.1 | Q75N |
| APG01037.1 | P77G |
| APG01037.1 | S78N |
| APG01037.1 | I81F |
| APG01037.1 | N89Q |
| APG01037.1 | H90P |
| APG01037.1 | S96E |
| APG01037.1 | G103E |
| APG01037.1 | N104Q |
| APG01037.1 | Q114K, Y, F, E |
| APG01037.1 | K124D |
| APG01037.1 | T126I |
| APG01037.1 | L127E |
| APG01037.1 | V130F |
| APG01037.1 | F137Y |
| APG01037.1 | S138N |
| APG01037.1 | V139F |
| APG01037.1 | S147N |
| APG01037.1 | T149E |
| APG01037.1 | S157P |
| APG01037.1 | V159Q |
| APG01037.1 | T160S |
| APG01037.1 | N162K |
| APG01037.1 | K168Q |
| APG01037.1 | K169R, M |
| APG01037.1 | K170E, Y, T |
| APG01037.1 | M177K, R |
| APG01037.1 | Q179K |
| APG01037.1 | M182G, L, V, I |
| APG01037.1 | N183Q |
| APG01037.1 | Q185R, K |
| APG01037.1 | Q191N |

TABLE 3-continued

| Gene name | AA position and change |
|---|---|
| APG01037.1 | S193M |
| APG01037.1 | F194Y |
| APG01037.1 | R200K |
| APG01037.1 | K201R |
| APG01037.1 | V202A, I |
| APG01037.1 | E203Q, D |
| APG01037.1 | D213E |
| APG01037.1 | N214F |
| APG01037.1 | S218K |
| APG01037.1 | T220D |
| APG01037.1 | T222P |
| APG01037.1 | K228N |
| APG01037.1 | F233Y |

The amino acid position denoted in Table 3 reflects the amino acid position of SEQ ID NO:208 (APG01037.0). The amino acid alterations set forth in Table 3 can be made in the corresponding amino acid positions of any one of SEQ ID NOs: 205, 206, 207, 208, 209, 210, 211, 212, 213, and/or 214. With respect to an amino acid sequence that is optimally aligned with a reference sequence, an amino acid residue "corresponds to" the position in the reference sequence with which the residue is paired in the alignment. The "position" is denoted by a number that sequentially identifies each amino acid in the reference sequence based on its position relative to the N-terminus. For example, in SEQ ID NO: 208 position 1 is L, position 2 is M, position 3 is P, etc. When a test sequence is optimally aligned with SEQ ID NO: 208, a residue in the test sequence that aligns with the P at position 3 is said to "correspond to position 3" of SEQ ID NO: 208. Owing to deletions, insertion, truncations, fusions, etc., that must be taken into account when determining an optimal alignment, in general the amino acid residue number in a test sequence as determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

iii. Sequence Comparisons

As used herein, the term "identity" or "percent identity" when used with respect to a particular pair of aligned amino acid sequences, refers to the percent amino acid sequence identity that is obtained by counting the number of identical matches in the alignment and dividing such number of identical matches by the length of the aligned sequences. As used herein, the term "similarity" or "percent similarity" when used with respect to a particular pair of aligned amino acid sequences, refers to the sum of the scores that are obtained from a scoring matrix for each amino acid pair in the alignment divided by the length of the aligned sequences.

Unless otherwise stated, identity and similarity will be calculated by the Needleman-Wunsch global alignment and scoring algorithms (Needleman and Wunsch (1970) *J. Mol. Biol.* 48(3):443-453) as implemented by the "needle" program, distributed as part of the EMBOSS software package (Rice, P. Longden, I. and Bleasby, A., EMBOSS: The European Molecular Biology Open Software Suite, 2000, *Trends in Genetics* 16, (6) pp 276-277, versions 6.3.1 available from EMBnet at embnet.org/resource/emboss and emboss.sourceforge.net, among other sources) using default gap penalties and scoring matrices (EBLOSUM62 for protein and EDNAFULL for DNA). Equivalent programs may also be used. By "equivalent program" is intended any sequence comparison program that, for any two sequences in question, generates an alignment having identical nucleotide residue matches and an identical percent sequence identity when compared to the corresponding alignment generated by needle from EMBOSS version 6.3.1.

Additional mathematical algorithms are known in the art and can be utilized for the comparison of two sequences. See, for example, the algorithm of Karlin and Altschul (1990) Proc. Natl. Acad. Sci. USA 87:2264, modified as in Karlin and Altschul (1993) Proc. Natl. Acad. Sci. USA 90:5873-5877. Such an algorithm is incorporated into the BLAST programs of Altschul et al. (1990) J. Mol. Biol. 215:403. BLAST nucleotide searches can be performed with the BLASTN program (nucleotide query searched against nucleotide sequences) to obtain nucleotide sequences homologous to pesticidal-like nucleic acid molecules of the invention, or with the BLASTX program (translated nucleotide query searched against protein sequences) to obtain protein sequences homologous to pesticidal nucleic acid molecules of the invention. BLAST protein searches can be performed with the BLASTP program (protein query searched against protein sequences) to obtain amino acid sequences homologous to pesticidal protein molecules of the invention, or with the TBLASTN program (protein query searched against translated nucleotide sequences) to obtain nucleotide sequences homologous to pesticidal protein molecules of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-Blast can be used to perform an iterated search that detects distant relationships between molecules. See Altschul et al. (1997) supra. When utilizing BLAST, Gapped BLAST, and PSI-Blast programs, the default parameters of the respective programs (e.g., BLASTX and BLASTN) can be used. Alignment may also be performed manually by inspection.

Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art and described, e.g., in Dayhoff et al. (1978) "A model of evolutionary change in proteins." In "Atlas of Protein Sequence and Structure," Vol. 5, Suppl. 3 (ed. M. O. Dayhoff), pp. 345-352. Natl. Biomed. Res. Found., Washington, D.C. and Henikoff et al. (1992) Proc. Natl. Acad. Sci. USA 89:10915-10919. The BLOSUM62 matrix is often used as a default scoring substitution matrix in sequence alignment protocols. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. While optimal alignment and scoring can be accomplished manually, the process is facilitated by the use of a computer-implemented alignment algorithm, e.g., gapped BLAST 2.0, described in Altschul et al. (1997) *Nucleic Acids Res.* 25:3389-3402, and made available to the public at the National Center for Biotechnology Information Website (www.ncbi.nlm.nih.gov). Optimal alignments, including multiple alignments, can be prepared using, e.g., PSI-BLAST, available through www.ncbi.nlm.nih.gov and described by Altschul et al. (1997) *Nucleic Acids Res.* 25:3389-3402.

iv. Antibodies

Antibodies to the polypeptides of the present invention, or to variants or fragments thereof, are also encompassed. Methods for producing antibodies are well known in the art (see, for example, Harlow and Lane (1988) Antibodies: A Laboratory Manual, Cold Spring Harbor Laboratory, Cold Spring Harbor, N.Y.; and U.S. Pat. No. 4,196,265). These antibodies can be used in kits for the detection and isolation of toxin polypeptides. Thus, this disclosure provides kits comprising antibodies that specifically bind to the polypeptides described herein, including, for example, polypeptides having the sequence of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218.

II. Pests

The compositions and methods provided herein are useful against a variety of pests. "Pests" includes but is not limited to, insects, fungi, bacteria, nematodes, acarids, protozoan pathogens, animal-parasitic liver flukes, and the like. Pests of particular interest are insect pests, particularly insect pests that cause significant damage to agricultural plants. Insect pests include insects selected from the orders Coleoptera, Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, or nematodes. In non-limiting embodiments, the insect pest comprises Western corn rootworm, *Diabrotica virgifera virgifera*; Fall armyworm, *Spodoptera frugiperda*; Colorado potato beetle, *Leptinotarsa decemlineata*; Corn earworm, *Helicoverpa zea* (in North America same species attacks cotton and called cotton bollworm); European corn borer, *Ostrinia nubilalis*; Black cutworm, *Agrotis ipsilon*; Diamondback moth, *Plutella xylostella*; Velvetbean caterpillar, *Anticarsia gemmatalis*; Southwestern corn borer, *Diatraea grandiosella*; Cotton bollworm, *Helicoverpa armigera* (found other than USA in rest of the world); Southern green stinkbug, *Nezara viridula*; Green stinkbug, *Chinavia halaris*; Brown marmorated stinkbug, *Halyomorpha halys*; and Brown stinbug, *Euschistus servus Euschistus heros* (Neotropical brown stink bug OR soy stink bug); *Piezodorus guildinii* (red-banded stink bug); *Dichelops melacanthus* (no common name) and/or *Dichelops furcatus* (no common name); an aphid, such as a soybean aphid. In other embodiments, the pest comprises a nematode including, but not limited to, *Meloidogyne hapla* (Northern root-knot nematode); *Meloidogyne enterolobii, Meloidogyne arenaria* (peanut root-knot nematode); and *Meloidogyne javanica*.

The term "insect pests" as used herein refers to insects and other similar pests such as, for example, those of the order Acari including, but not limited to, mites and ticks. Insect pests of the present invention include, but are not limited to, insects of the order Lepidoptera, e.g. *Achoroia grisella, Acleris gloverana, Acleris variana, Adoxophyes orana, Agrotis ipsilon, Alabama argillacea, Alsophila pometaria, Amyelois transitella, Anagasta kuehniella, Anarsia lineatella, Anisota senatoria, Antheraea pernyi, Anticarsia gemmatalis, Archips* sp., *Argyrotaenia* sp., *Athetis mindara, Bombyx mori, Bucculatrix thurberiella, Cadra cautella, Choristoneura* sp., *Cochylls hospes, Colias eurytheme, Corcyra cephalonica, Cydia latiferreanus, Cydia pomonella, Datana integerrima, Dendrolimus sibericus, Desmiafeneralis, Diaphania hyalinata, Diaphania nitidalis, Diatraea grandiosella, Diatraea saccharalis, Ennomos subsignaria, Eoreuma loftini, Esphestia elutella, Erannis tilaria, Estigmene acrea, Eulia salubricola, Eupocoellia ambiguella, Eupoecilia ambiguella, Euproctis chrysorrhoea, Euxoa messoria, Galleria mellonella, Grapholita molesta, Harrisina americana, Helicoverpa subflexa, Helicoverpa zea, Heliothis virescens, Hemileuca oliviae, Homoeosoma electellum, Hyphantia cunea, Keiferia lycopersicella, Lambdina fiscellaria fiscellaria, Lambdina fiscellaria lugubrosa, Leucoma salicis, Lobesia botrana, Loxostege sticticalis, Lymantria dispar, Macalla thyrisalis, Malacosoma* sp., *Mamestra brassicae, Mamestra configurata, Manduca quinquemaculata, Manduca sexta, Maruca testulalis, Melanchra picta, Operophtera brumata, Orgyia* sp., *Ostrinia nubilalis, Paleacrita vernata, Papilio cresphontes, Pectinophora gossypiella, Phryganidia californica, Phyllonorycter blancardella, Pieris napi, Pieris rapae, Plathypena scabra, Platynota flouendanci, Platynota stultana, Platyptilia carduidactyla, Plodia interpunctella, Plutella xylostella, Pontia protodice, Pseudaletia unipuncta, Pseudoplasia includens, Sabulodes aegrotata, Schizura concinna, Sitotroga cerealella, Spilonta ocellana, Spodoptera* sp., *Thaurnstopoea pityocampa, Tinsola bisselliella, Trichoplusia hi, Udea rubigalis, Xylomyges curiails*, and *Yponomeuta padella*.

Insect pests also include insects selected from the orders Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, Coleoptera. Insect pests of the invention for the major crops include, but are not limited to: Maize: *Ostrinia nubilalis*, European corn borer; *Agrotis ipsilon*, black cutworm; *Helicoverpa zeae*, corn earworm; *Spodoptera frugiperda*, fall armyworm; *Diatraea grandiosella*, southwestern corn borer; *Elasmopalpus lignosellus*, lesser cornstalk borer; *Diatraea saccharalis*, surgarcane borer; western corn rootworm, e.g., *Diabrotica virgifera virgifera*; northern corn rootworm, e.g., *Diabrotica longicornis barberi*; southern corn rootworm, e.g., *Diabrotica undecimpunctata howardi; Melanotus* spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blotch leafminer; *Anaphothrips obscrurus*, grass thrips; *Solenopsis milesta*, thief ant; *Tetranychus urticae*, two spotted spider mite; Sorghum: *Chilo partellus*, sorghum borer; *Spodoptera frugiperda*, fall armyworm; *Helicoverpa zea*, corn earworm; *Elasmopalpus lignosellus*, leser cornstalk borer; *Feltia subterranea*, granulate cutworm; *Phyllophaga crinita*, white grub; *Eleodes, Conoderus*, and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*; corn leaf aphid; *Sipha flava*, yellow sugarcane aphid; chinch bug, e.g., *Blissus leucopterus leucopterus; Contarinia sorghicola*, sorghum midge; *Tetranychus cinnabarinus*, carmine spider mite; *Tetranychus urticae*, two-spotted spider mite; Wheat: *Pseudaletia unipunctata*, army worm; *Spodoptera frugiperda*, fall armyworm; *Elasmopalpus lignosellus*, lesser cornstalk borer; *Agrotis orthogonia*, pale western cutworm; *Elasmopalpus lignosellus*, lesser cornstalk borer; *Oulema melanopus*, cereal leaf beetle; *Hypera punctata*, clover leaf weevil; southern corn rootworm, e.g., *Diabrotica undecimpunctata howardi*; Russian wheat aphid; *Schizaphis graminum*, greenbug; *Macrosiphum avenae*, English grain aphid; *Melanoplus femurrubrum*, redlegged grasshopper; *Melanoplus differentialis*, differential grasshopper; *Melanoplus sanguinipes*, migratory grasshopper; *Mayetiola destructor*, Hessian fly; *Sitodiplosis mosellana*, wheat midge; *Meromyza americana*, wheat stem maggot; *Hylemya coarctata*, wheat bulb fly; *Frankliniella fusca*, tobacco thrips; *Cephus cinctus*, wheat stem sawfly; *Aceria tulipae*, wheat curl mite; Sunflower: *Cylindrocupturus adspersus*, sunflower stem weevil; *Smicronyx fulus*, red sunflower seed weevil; *Smicronyx sordidus*, gray sunflower seed weevil; *Suleima helianthana*, sunflower bud moth; *Homoeosoma electellum*, sunflower moth; *Zygogramma exclamationis*, sunflower beetle; *Bothyrus gibbosus*, carrot beetle; *Neolasioptera murtfeldtiana*, sunflower seed midge; Cotton: *Heliothis virescens*, tobacco budworm; *Helicoverpa zea*, cotton bollworm; *Spodoptera exigua*, beet armyworm; *Pectinophora gossypiella*, pink bollworm; boll weevil, e.g., *Anthonomus grandis; Aphis gossypii*, cotton aphid; *Pseudatomoscelis seriatus*, cotton fleahopper; *Trialeurodes abutilonea*, bandedwinged whitefly; *Lygus lineolaris*, tarnished plant bug; *Melanoplus femurrubrum*, redlegged grasshopper; *Melanoplus differentialis*, differential grasshopper; *Thrips tabaci*, onion thrips; *Franklinkiella fusca*, tobacco thrips; *Tetranychus cinnabarinus*, carmine spider mite; *Tetranychus urticae*, two-spotted spider mite; Rice: *Diatraea saccharalis*, sugarcane borer; *Spodoptera frugiperda*, fall armyworm; *Helicoverpa zea*, corn earworm; *Colaspis brunnea*, grape colaspis; *Lissorhoptrus oryzophilus*, rice water weevil; *Sitophilus oryzae*, rice weevil; *Nephotettix nigropictus*, rice leafhoper; chinch bug, e.g., *Blissus leucopterus leucopterus; Acrosternum hilare*, green stink bug; Soybean: *Pseudoplusia includens*, soybean looper; *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, tobacco budworm; *Helicoverpa zea*, cotton bollworm; *Epilachna varivestis*, Mexican bean beetle; *Myzus persicae*, green peach aphid; *Empoasca fabae*, potato leafhopper; *Acrosternum hilare*, green stink bug; *Melanoplus femurrubrum*, redlegged grasshopper; *Melanoplus differentialis*, differential grasshopper; *Hylemya platura*, seedcorn maggot; *Sericothrips variabilis*, soybean thrips; *Thrips tabaci*, onion thrips; *Tetranychus turkestani*, strawberry spider mite; *Tetranychus urticae*, two-spotted spider mite; Barley: *Ostrinia nubilalis*, European corn borer; *Agrotis ipsilon*, black cutworm; *Schizaphis graminum*, greenbug; chinch bug, e.g.,

*Blissus leucopterus leucopterus*; *Acrosternum hilare*, green stink bug; *Euschistus servus*, brown stink bug; *Jylemya platura*, seedcorn maggot; *Mayetiola destructor*, Hessian fly; *Petrobia latens*, brown wheat mite; Oil Seed Rape: *Vrevicoryne brassicae*, cabbage aphid; *Phyllotreta cruciferae*, crucifer flea beetle; *Phyllotreta striolata*, striped flea beetle; *Phyllotreta nemorum*, striped turnip flea beetle; *Meligethes aeneus*, rapeseed beetle; and the pollen beetles *Meligethes rufimanus*, *Meligethes nigrescens*, *Meligethes canadianus*, and *Meligethes viridescens*; Potato: *Leptinotarsa decemlineata*, Colorado potato beetle.

The methods and compositions provided herein may be effective against Hemiptera such as *Lygus hesperus, Lygus lineolaris, Lygus pratensis, Lygus rugulipennis Popp, Lygus pabulinus, Calocoris norvegicus, Orthops compestris, Plesiocoris rugicollis, Cyrtopeltis modestus, Cyrtopeltis notatus, Spanagonicus albofasciatus, Diaphnocoris chlorinonis, Labopidicola allii, Pseudatomoscelis seriatus, Adelphocoris rapidus, Poecilocapsus lineatus, Blissus leucopterus, Nysius ericae, Nysius raphanus, Euschistus servus, Nezara viridula*, Eurygaster, Coreidae, Pyrrhocoridae, Tinidae, Blostomatidae, Reduviidae, and Cimicidae. Pests of interest also include *Araecerus fasciculatus*, coffee bean weevil; *Acanthoscelides obtectus*, bean weevil; *Bruchus rufmanus*, broadbean weevil; *Bruchus pisorum*, pea weevil; *Zabrotes subfasciatus*, Mexican bean weevil; *Diabrotica balteata*, banded cucumber beetle; *Cerotoma trifurcata*, bean leaf beetle; *Diabrotica virgifera*, Mexican corn rootworm; *Epitrix cucumeris*, potato flea beetle; *Chaetocnema confinis*, sweet potato flea beetle; *Hypera postica*, alfalfa weevil; *Anthonomus quadrigibbus*, apple curculio; *Sternechus paludatus*, bean stalk weevil; *Hypera brunnipennis*, Egyptian alfalfa weevil; *Sitophilus granaries*, granary weevil; *Craponius inaequalis*, grape curculio; *Sitophilus zeamais*, maize weevil; *Conotrachelus nenuphar*, plum curculio; *Euscepes postfaciatus*, West Indian sweet potato weevil; *Maladera castanea*, Asiatic garden beetle; *Rhizotrogus majalis*, European chafer; *Macrodactylus subspinosus*, rose chafer; *Tribolium confusum*, confused flour beetle; *Tenebrio obscurus*, dark mealworm; *Tribolium castaneum*, red flour beetle; *Tenebrio molitor*, yellow mealworm.

Nematodes include parasitic nematodes such as root-knot, cyst, and lesion nematodes, including *Heterodera* spp., *Meloidogyne* spp., and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include *Pratylenchus* spp.

Insect pests may be tested for pesticidal activity of compositions of the invention in early developmental stages, e.g., as larvae or other immature forms. The insects may be reared in total darkness at from about 20 degree C. to about 30 degree C. and from about 30% to about 70% relative humidity. Bioassays may be performed as described in Czapla and Lang (1990) *J. Econ. Entomol.* 83 (6): 2480-2485. See, also the experimental section herein.

III. Expression Cassettes

Polynucleotides encoding the pesticidal proteins provided herein can be provided in expression cassettes for expression in an organism of interest. The cassette will include 5' and 3' regulatory sequences operably linked to a polynucleotide encoding a pesticidal polypeptide provided herein that allows for expression of the polynucleotide. The cassette may additionally contain at least one additional gene or genetic element to be cotransformed into the organism. Where additional genes or elements are included, the components are operably linked. Alternatively, the additional gene(s) or element(s) can be provided on multiple expression cassettes. Such an expression cassette is provided with a plurality of restriction sites and/or recombination sites for insertion of the polynucleotides to be under the transcriptional regulation of the regulatory regions. The expression cassette may additionally contain a selectable marker gene.

The expression cassette will include in the 5'-3' direction of transcription, a transcriptional and translational initiation region (i.e., a promoter), a pesticidal polynucleotide of the invention, and a transcriptional and translational termination region (i.e., termination region) functional in the organism of interest, i.e., a plant or bacteria. The promoters of the invention are capable of directing or driving expression of a coding sequence in a host cell. The regulatory regions (i.e., promoters, transcriptional regulatory regions, and translational termination regions) may be endogenous or heterologous to the host cell or to each other. As used herein, "heterologous" in reference to a sequence is a sequence that originates from a foreign species, or, if from the same species, is substantially modified from its native form in composition and/or genomic locus by deliberate human intervention. As used herein, a chimeric gene comprises a coding sequence operably linked to a transcription initiation region that is heterologous to the coding sequence.

Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Additional regulatory signals include, but are not limited to, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EPO 0480762A2; Sambrook et al. (1992) Molecular Cloning: A Laboratory Manual, ed. Maniatis et al. (Cold Spring Harbor Laboratory Press, Cold Spring Harbor, N.Y.), hereinafter "Sambrook 11"; Davis et al., eds. (1980) Advanced Bacterial Genetics (Cold Spring Harbor Laboratory Press), Cold Spring Harbor, N.Y., and the references cited therein.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, inducible, tissue-preferred, or other promoters for expression in the organism of interest. See, for example, promoters set forth in WO 99/43838 and in U.S. Pat. Nos. 8,575,425; 7,790,846; 8,147,856; 8,586832; 7,772,369; 7,534,939; 6,072,050; 5,659,026; 5,608,149; 5,608,144; 5,604,121; 5,569,597; 5,466,785; 5,399,680; 5,268,463; 5,608,142; and 6,177,611; herein incorporated by reference.

For expression in plants, constitutive promoters also include CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730). Inducible promoters include those that drive expression of pathogenesis-related proteins (PR proteins), which are induced following infection by a pathogen. See, for example, Redolfi et al. (1983) *Neth. J. Plant Pathol.* 89:245-254; Uknes et al. (1992) *Plant Cell* 4:645-656; and Van Loon (1985) *Plant Mol. Virol.* 4:111-116; and WO 99/43819, herein incorporated by reference. Promoters that are expressed locally at or near the site of pathogen infection may also be used (Marineau et al. (1987) *Plant Mol. Biol.* 9:335-342; Matton et al. (1989) *Molecular Plant-Microbe Interactions* 2:325-331; Somsisch et al. (1986) *Proc. Natl. Acad. Sci. USA* 83:2427-2430; Somsisch et al. (1988) *Mol. Gen. Genet.* 2:93-98; and Yang (1996) *Proc. Natl. Acad. Sci. USA* 93:14972-14977; Chen et al. (1996) *Plant J.* 10:955-966; Zhang et al. (1994) *Proc. Natl. Acad. Sci. USA* 91:2507-2511; Warner et al. (1993) *Plant J.* 3:191-201; Siebertz et al. (1989) *Plant Cell* 1:961-968; Cordero et al. (1992) *Physiol. Mol. Plant Path.* 41:189-200; U.S. Pat. No. 5,750,386 (nematode-inducible); and the references cited therein).

Wound-inducible promoters may be used in the constructions of the invention. Such wound-inducible promoters include pin II promoter (Ryan (1990) *Ann. Rev. Phytopath.* 28:425-449; Duan et al. (1996) *Nature Biotechnology* 14:494-498); wun1 and wun2 (U.S. Pat. No. 5,428,148); win1 and win2 (Stanford et al. (1989) *Mol. Gen. Genet.* 215:200-208); systemin (McGurl et al. (1992) *Science* 225:1570-1573); WIP1 (Rohmeier et al. (1993) *Plant Mol. Biol.* 22:783-792; Eckelkamp et al. (1993) *FEBS Letters* 323:73-76); MPI gene (Corderok et al. (1994) *Plant J.* 6(2):141-150); and the like, herein incorporated by reference.

Tissue-preferred promoters for use in the invention include those set forth in Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505.

Leaf-preferred promoters include those set forth in Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590.

Root-preferred promoters are known and include those in Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element); Sanger et al. (1990) *Plant Mol. Biol.* 14(3):433-443 (mannopine synthase (MAS) gene of *Agrobacterium tumefaciens*); and Miao et al. (1991) *Plant Cell* 3(1):11-22 (cytosolic glutamine synthetase (GS)); Bogusz et al. (1990) *Plant Cell* 2(7):633-641; Leach and Aoyagi (1991) *Plant Science* (Limerick) 79(1):69-76 (rolC and rolD); Teeri et al. (1989) *EMBO J.* 8(2):343-350; Kuster et al. (1995) *Plant Mol. Biol.* 29(4):759-772 (the VfENOD-GRP3 gene promoter); and, Capana et al. (1994) *Plant Mol. Biol.* 25(4):681-691 (rolB promoter). See also U.S. Pat. Nos. 5,837,876; 5,750,386; 5,633,363; 5,459,252; 5,401,836; 5,110,732; and 5,023,179.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108. Seed-preferred promoters include, but are not limited to, Cim1 (cytokinin-induced message); cZ19B1 (maize 19 kDa zein); milps (myo-inositol-1-phosphate synthase) (see WO 00/11177 and U.S. Pat. No. 6,225,529). Gamma-zein is an endosperm-specific promoter. Globulin 1 (Glb-1) is a representative embryo-specific promoter. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, gamma-zein, waxy, shrunken 1, shrunken 2, Globulin 1, etc. See also WO 00/12733, where seed-preferred promoters from end1 and end2 genes are disclosed.

For expression in a bacterial host, promoters that function in bacteria are well-known in the art. Such promoters include any of the known crystal protein gene promoters, including the promoters of any of the pesticidal proteins of the invention, and promoters specific for *B. thuringiensis* sigma factors. Alternatively, mutagenized or recombinant crystal protein-encoding gene promoters may be recombinantly engineered and used to promote expression of the novel gene segments disclosed herein.

The expression cassette can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers are known and any can be used. See, for example, PCT/US2015/066648, filed on Dec. 18, 2015, herein incorporated by reference in its entirety, which discloses glufosinate resistance sequences that can be employed as selectable markers.

IV. Methods, Host Cells and Plant Cells

As indicated, DNA constructs comprising nucleotide sequences encoding the pesticidal proteins or active variants or fragment thereof can be used to transform plants of interest or other organisms of interest. Methods for transformation involve introducing a nucleotide construct into a plant. By "introducing" is intended to introduce the nucleotide construct to the plant or other host cell in such a manner that the construct gains access to the interior of a cell of the plant or host cell. The methods of the invention do not require a particular method for introducing a nucleotide construct to a plant or host cell, only that the nucleotide construct gains access to the interior of at least one cell of the plant or the host organism. Methods for introducing nucleotide constructs into plants and other host cells are known in the art including, but not limited to, stable transformation methods, transient transformation methods, and virus-mediated methods.

The methods result in a transformed organisms, such as a plant, including whole plants, as well as plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

Transgenic plants" or "transformed plants" or "stably transformed" plants or cells or tissues refers to plants that have incorporated or integrated a polynucleotide encoding at least one pesticidal polypeptide of the invention. It is recognized that other exogenous or endogenous nucleic acid sequences or DNA fragments may also be incorporated into the plant cell. *Agrobacterium*- and biolistic-mediated transformation remain the two predominantly employed approaches. However, transformation may be performed by infection, transfection, microinjection, electroporation, microprojection, biolistics or particle bombardment, electroporation, silica/carbon fibers, ultrasound mediated, PEG mediated, calcium phosphate co-precipitation, polycation DMSO technique, DEAE dextran procedure, Agro and viral mediated (Caulimoriviruses, Geminiviruses, RNA plant viruses), liposome mediated and the like.

Transformation protocols as well as protocols for introducing polypeptides or polynucleotide sequences into plants may vary depending on the type of plant or plant cell, i.e., monocot or dicot, targeted for transformation. Methods for transformation are known in the art and include those set forth in U.S. Pat. Nos. 8,575,425; 7,692,068; 8,802,934; 7,541,517; each of which is herein incorporated by reference. See, also, Rakoczy-Trojanowska, M. (2002) *Cell Mol Biol Lett.* 7:849-858; Jones et al. (2005) *Plant Methods* 1:5; Rivera et al. (2012) *Physics of Life Reviews* 9:308-345; Bartlett et al. (2008) *Plant Methods* 4:1-12; Bates, G. W. (1999) *Methods in Molecular Biology* 111:359-366; Binns and Thomashow (1988) *Annual Reviews in Microbiology* 42:575-606; Christou, P. (1992) *The Plant Journal* 2:275-281; Christou, P. (1995) *Euphytica* 85:13-27; Tzfira et al. (2004) *TRENDS in Genetics* 20:375-383; Yao et al. (2006) *Journal of Experimental Botany* 57:3737-3746; Zupan and Zambryski (1995) *Plant Physiology* 107:1041-1047; Jones et al. (2005) *Plant Methods* 1:5;

Transformation may result in stable or transient incorporation of the nucleic acid into the cell. "Stable transformation" is intended to mean that the nucleotide construct introduced into a host cell integrates into the genome of the host cell and is capable of being inherited by the progeny thereof. "Transient transformation" is intended to mean that a polynucleotide is introduced into the host cell and does not integrate into the genome of the host cell.

Methods for transformation of chloroplasts are known in the art. See, for example, Svab et al. (1990) Proc. Nail. Acad. Sci. USA 87:8526-8530; Svab and Maliga (1993) Proc. Natl. Acad. Sci. USA 90:913-917; Svab and Maliga (1993) EMBO J. 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) Proc. Natl. Acad. Sci. USA 91:7301-7305.

The cells that have been transformed may be grown into plants in accordance with conventional ways. See, for example, McCormick et al. (1986) Plant Cell Reports 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

In specific embodiments, the sequences provide herein can be targeted to specific cite within the genome of the host cell or plant cell. Such methods include, but are not limited to, meganucleases designed against the plant genomic sequence of interest (D'Halluin et al. 2013 *Plant Biotechnol J*); CRISPR-Cas9, TALENs, and other technologies for precise editing of genomes (Feng, et al. *Cell Research* 23:1229-1232, 2013, Podevin, et al. *Trends Biotechnology*, online publication, 2013, Wei et al., *J Gen Genomics,* 2013, Zhang et al (2013) WO 2013/026740); Cre-lox site-specific recombination (Dale et al. (1995) *Plant J* 7:649-659; Lyznik, et al. (2007) *Transgenic Plant J* 1:1-9; FLP-FRT recombination (Li et al. (2009) *Plant Physiol* 151:1087-1095); Bxb1-mediated integration (Yau et al. *Plant J* (2011) 701: 147-166); zinc-finger mediated integration (Wright et al. (2005) *Plant J* 44:693-705); Cai et al. (2009) *Plant Mol Biol* 69:699-709); and homologous recombination (Lieberman-Lazarovich and Levy (2011) *Methods Mol Biol* 701: 51-65); Puchta (2002) *Plant Mol Biol* 48:173-182).

The sequence provided herein may be used for transformation of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, papaya, cashew, macadamia, almond, oats, vegetables, ornamentals, and conifers.

Vegetables include, but are not limited to, tomatoes, lettuce, green beans, lima beans, peas, and members of the genus *Curcumis* such as cucumber, cantaloupe, and musk melon. Ornamentals include, but are not limited to, azalea, hydrangea, hibiscus, roses, tulips, daffodils, petunias, carnation, poinsettia, and chrysanthemum. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape, etc.).

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides. Further provided is a processed plant product or byproduct that retains the sequences disclosed herein, including for example, soymeal.

In another embodiment, the genes encoding the pesticidal proteins can be used to transform insect pathogenic organisms. Such organisms include baculoviruses, fungi, protozoa, bacteria, and nematodes. Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the pesticidal protein, and desirably, provide for improved protection of the pesticide from environmental degradation and inactivation.

Such microorganisms include archaea, bacteria, algae, and fungi. Of particular interest are microorganisms such as bacteria, e.g., *Bacillus, Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*. Fungi include yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas aeruginosa, Pseudomonas fluorescens, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinlandir* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces rosues, S. odorus, Kluyveromyces veronae, Aureobasidium pollulans, Bacillus thuringiensis, Escherichia coli, Bacillus subtilis*, and the like.

Illustrative prokaryotes, both Gram-negative and grampositive, include Enterobacteriaceae, such as *Escherichia, Erwinia, Shigella, Salmonella*, and *Proteus*; Bacillaceae; Rhizobiceae, such as *Rhizobium*; Spirillaceae, such as photobacterium, *Zymomonas, Serratia, Aeromonas, Vibrio, Desulfovibrio, Spirillum*; Lactobacillaceae; Pseudomonadaceae, such as *Pseudomonas* and *Acetobacter*; Azotobacteraceae and Nitrobacteraceae. Fungi include Phycomycetes and Ascomycetes, e.g., yeast, such as *Saccharomyces* and *Schizosaccharomyces*; and Basidiomycetes yeast, such as *Rhodotorula, Aureobasidium, Sporobolomyces*, and the like.

Genes encoding pesticidal proteins can be introduced by means of electrotransformation, PEG induced transformation, heat shock, transduction, conjugation, and the like. Specifically, genes encoding the pesticidal proteins can be cloned into a shuttle vector, for example, pHT3101 (Lerecius et al. (1989) *FEMS Microbiol. Letts.* 60: 211-218. The shuttle vector pHT3101 containing the coding sequence for the particular pesticidal protein gene can, for example, be transformed into the root-colonizing *Bacillus* by means of electroporation (Lerecius et al. (1989) *FEMS Microbiol. Letts.* 60: 211-218).

Expression systems can be designed so that pesticidal proteins are secreted outside the cytoplasm of gram-negative bacteria by fusing an appropriate signal peptide to the amino-terminal end of the pesticidal protein. Signal peptides recognized by *E. coli* include the OmpA protein (Ghrayeb et al. (1984) *EMBO J*, 3: 2437-2442).

Pesticidal proteins and active variants thereof can be fermented in a bacterial host and the resulting bacteria processed and used as a microbial spray in the same manner that *Bacillus thuringiensis* strains have been used as insecticidal sprays. In the case of a pesticidal protein(s) that is secreted from *Bacillus*, the secretion signal is removed or mutated using procedures known in the art. Such mutations and/or deletions prevent secretion of the pesticidal protein(s) into the growth medium during the fermentation process. The pesticidal proteins are retained within the cell, and the cells are then processed to yield the encapsulated pesticidal proteins.

Alternatively, the pesticidal proteins are produced by introducing heterologous genes into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated pesticidal proteins may then be formulated in accordance with conventional techniques for application to the environment hosting a target pest, e.g., soil, water, and foliage of plants. See, for example U.S. Pat. No. 6,468,523 and U.S. Publication No. 20050138685, and the references cited therein. In the present invention, a transformed microorganism (which includes whole organisms, cells, spore(s), pesticidal protein(s), pesticidal component(s), pest-impacting component(s), mutant(s), living or dead cells and cell components, including mixtures of living and dead cells and cell components, and including broken cells and cell components) or an isolated pesticidal protein can be formulated with an acceptable carrier into a pesticidal or agricultural composition(s) that is, for example, a suspension, a solution, an emulsion, a dusting powder, a dispersible granule, a wettable powder, and an emulsifiable concentrate, an aerosol, an impregnated granule, an adjuvant, a coatable paste, and also encapsulations in, for example, polymer substances.

Agricultural compositions may comprise a polypeptide, a recombinogenic polypeptide or a variant or fragment thereof, as disclosed herein. The agricultural composition disclosed herein may be applied to the environment of a plant or an area of cultivation, or applied to the plant, plant part, plant cell, or seed.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematicides, molluscicides, acaracides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the present invention are normally applied in the form of compositions and can be applied to the crop area, plant, or seed to be treated. For example, the compositions of the present invention may be applied to grain in preparation for or during storage in a grain bin or silo, etc. The compositions of the present invention may be applied simultaneously or in succession with other compounds. Methods of applying an active ingredient of the present invention or an agrochemical composition of the present invention that contains at least one of the pesticidal proteins produced by the bacterial strains of the present invention include, but are not limited to, foliar application, seed coating, and soil application. The number of applications and the rate of application depend on the intensity of infestation by the corresponding pest.

Suitable surface-active agents include, but are not limited to, anionic compounds such as a carboxylate of, for example, a metal; a carboxylate of a long chain fatty acid; an N-acylsarcosinate; mono or di-esters of phosphoric acid with fatty alcohol ethoxylates or salts of such esters; fatty alcohol sulfates such as sodium dodecyl sulfate, sodium octadecyl sulfate or sodium cetyl sulfate; ethoxylated fatty alcohol sulfates; ethoxylated alkylphenol sulfates; lignin sulfonates; petroleum sulfonates; alkyl aryl sulfonates such as alkyl-benzene sulfonates or lower alkylnaphtalene sulfonates, e.g., butyl-naphthalene sulfonate; salts of sulfonated naphthalene-formaldehyde condensates; salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate of dioctyl succinate. Non-ionic agents include condensation products of fatty acid esters, fatty alcohols, fatty acid amides or fatty-alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitar fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include but are not limited to inorganic minerals such as kaolin, phyllosilicates, carbonates, sulfates, phosphates, or botanical materials such as cork, powdered corncobs, peanut hulls, rice hulls, and walnut shells.

The compositions of the present invention can be in a suitable form for direct application or as a concentrate of primary composition that requires dilution with a suitable quantity of water or other diluant before application. The pesticidal concentration will vary depending upon the nature of the particular formulation, specifically, whether it is a concentrate or to be used directly. The composition contains 1 to 98% of a solid or liquid inert carrier, and 0 to 50% or 0.1 to 50% of a surfactant. These compositions will be administered at the labeled rate for the commercial product, for example, about 0.01 lb-5.0 lb. per acre when in dry form and at about 0.01 pts.-10 pts. per acre when in liquid form.

In a further embodiment, the compositions, as well as the transformed microorganisms and pesticidal proteins, provided herein can be treated prior to formulation to prolong the pesticidal activity when applied to the environment of a target pest as long as the pretreatment is not deleterious to the pesticidal activity. Such treatment can be by chemical and/or physical means as long as the treatment does not deleteriously affect the properties of the composition(s). Examples of chemical reagents include but are not limited to halogenating agents; aldehydes such as formaldehyde and glutaraldehyde; anti-infectives, such as zephiran chloride; alcohols, such as isopropanol and ethanol; and histological fixatives, such as Bouin's fixative and Helly's fixative (see, for example, Humason (1967) *Animal Tissue Techniques* (W.H. Freeman and Co.).

In one aspect, pests may be killed or reduced in numbers in a given area by application of the pesticidal proteins provided herein to the area. Alternatively, the pesticidal proteins may be prophylactically applied to an environmental area to prevent infestation by a susceptible pest. Preferably the pest ingests, or is contacted with, a pesticidally-effective amount of the polypeptide. By "pesticidally-effective amount" is intended an amount of the pesticide that is able to bring about death to at least one pest, or to noticeably reduce pest growth, feeding, or normal physiological development. This amount will vary depending on such factors as, for example, the specific target pests to be controlled, the specific environment, location, plant, crop, or agricultural site to be treated, the environmental conditions, and the method, rate, concentration, stability, and quantity of application of the pesticidally-effective polypeptide composition. The formulations or compositions may also vary with respect to climatic conditions, environmental considerations, and/or frequency of application and/or severity of pest infestation.

The active ingredients are normally applied in the form of compositions and can be applied to the crop area, plant, or seed to be treated. Methods are therefore provided for providing to a plant, plant cell, seed, plant part or an area of cultivation, an effective amount of the agricultural composition comprising the polypeptide, recombinogenic polypeptide or an active variant or fragment thereof. By "effective amount" is intended an amount of a protein or composition has pesticidal activity that is sufficient to kill or control the pest or result in a noticeable reduction in pest growth, feeding, or normal physiological development. Such decreases in numbers, pest growth, feeding or normal development can comprise any statistically significant decrease, including, for example a decrease of about 5%, 10%, 15%, 20%, 25%, 30%, 35%, 40%, 45%, 50%, 55%, 60%, 65%, 70%, 75%, 85%, 90%, 95% or greater.

For example, the compositions may be applied to grain in preparation for or during storage in a grain bin or silo, etc. The compositions may be applied simultaneously or in succession with other compounds. Methods of applying an active ingredient or an agrochemical composition comprising at least one of the polypeptides, recombinogenic polypeptides or variants or fragments thereof as disclosed herein, include but are not limited to, foliar application, seed coating, and soil application.

Methods for increasing plant yield are provided. The methods comprise providing a plant or plant cell expressing a polynucleotide encoding the pesticidal polypeptide sequence disclosed herein and growing the plant or a seed thereof in a field infested with (or susceptible to infestation by) a pest against which said polypeptide has pesticidal activity. In some embodiments, the polypeptide has pesticidal activity against a lepidopteran, coleopteran, dipteran, hemipteran, or nematode pest, and said field is infested with a lepidopteran, hemipteran, coleopteran, dipteran, or nematode pest. As defined herein, the "yield" of the plant refers to the quality and/or quantity of biomass produced by the plant. By "biomass" is intended any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence. In specific methods, plant yield is increased as a result of improved pest resistance of a plant expressing a pesticidal protein disclosed herein. Expression of the pesticidal protein results in a reduced ability of a pest to infest or feed.

The plants can also be treated with one or more chemical compositions, including one or more herbicide, insecticides, or fungicides.

Non-limiting embodiments include:

Embodiment 1

An isolated polypeptide having insecticidal activity, comprising:

(a) a polypeptide comprising an amino acid sequence selected from the group consisting of sequences set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218; or (b) a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218.

Embodiment 2

The polypeptide of embodiment 1, wherein said polypeptide comprises the amino acid sequence set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, or 218.

Embodiment 3

The polypeptide of embodiment 1 or 2, further comprising heterologous amino acid sequences.

Embodiment 4

A composition comprising the polypeptide of any one of embodiments 1-3.

Embodiment 5

A recombinant nucleic acid molecule that encodes the polypeptide of any one of embodiments 1, 2, or 4, wherein said recombinant nucleic acid molecule is not the naturally occurring sequence encoding said polypeptide.

Embodiment 6

The recombinant nucleic acid of embodiment 5, wherein said nucleic acid molecule is a synthetic sequence that has been designed for expression in a plant.

Embodiment 7

The recombinant nucleic acid molecule of embodiments 5 or 6, wherein said nucleic acid molecule is operably linked to a promoter capable of directing expression in a plant cell.

Embodiment 8

The recombinant nucleic acid molecule of embodiment 5, wherein said nucleic acid molecule is operably linked to a promoter capable of directing expression in a bacteria.

Embodiment 9

A host cell that contains the recombinant nucleic acid molecule of any one of embodiments 5-8.

Embodiment 10

The host cell of embodiment 9, wherein said host cell is a bacterial host cell.

Embodiment 11

A DNA construct comprising a promoter that drives expression in a plant cell operably linked to a recombinant nucleic acid molecule comprising:

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, and/or 218.

Embodiment 12

The DNA construct of embodiment 11, wherein said nucleotide sequence is a synthetic DNA sequence that has been designed for expression in a plant.

Embodiment 13

A vector comprising the DNA construct of embodiments 11 or 12.

Embodiment 14

A host cell that contains the DNA construct of embodiments 11 or 12 or the vector of embodiment 13.

Embodiment 15

The host cell of embodiment 14, wherein the host cell is a plant cell.

Embodiment 16

A transgenic plant comprising the host cell of embodiment 15.

Embodiment 17

A composition comprising the host cell of embodiments 9, 10, 14, or 15.

Embodiment 18

The composition of embodiment 17, wherein said composition is selected from the group consisting of a powder, dust, pellet, granule, spray, emulsion, colloid, and solution.

Embodiment 19

The composition of embodiments 16 or 17, wherein said composition comprises from about 1% to about 99% by weight of said polypeptide.

Embodiment 20

A method for controlling a pest population comprising contacting said population with a pesticidal-effective amount of the composition of any one of embodiments 17-19.

Embodiment 21

A method for killing a pest population comprising contacting said population with a pesticidal-effective amount of the composition of any one of embodiments 17-19.

Embodiment 22

A method for producing a polypeptide with pesticidal activity, comprising culturing the host cell of any one of embodiments 9, 10, 14, or 15 under conditions in which the nucleic acid molecule encoding the polypeptide is expressed.

Embodiment 23

A plant having stably incorporated into its genome a DNA construct comprising a nucleotide sequence that encodes a protein having pesticidal activity, said nucleotide sequence comprising:
(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, or 218; or,
(b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, or 218.

Embodiment 24

A transgenic seed of the plant of embodiment 23.

Embodiment 25

A method for protecting a plant from an insect pest, comprising expressing in a plant or cell thereof a nucleotide sequence that encodes a pesticidal polypeptide, said nucleotide sequence comprising:

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, or 218; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, or 218.

Embodiment 26

The method of embodiment 25, wherein said plant produces a pesticidal polypeptide having pesticidal against a lepidopteran or coleopteran pest.

Embodiment 27

A method for increasing yield in a plant comprising growing in a field a plant or seed thereof having stably incorporated into its genome a DNA construct comprising a promoter that drives expression in a plant operably linked to a nucleotide sequence that encodes a pesticidal polypeptide, wherein said nucleotide sequence comprises:

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, or 218; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, or 218.

Embodiment 28

A method of obtaining a polynucleotide that encodes an improved polypeptide comprising pesticidal activity is provided, wherein the improved polypeptide has at least one improved property over any one of SEQ ID NOS: 1-218 comprising:

(a) recombining a plurality of parental polynucleotides comprising SEQ ID NO: 1-218 or an active variant or fragment thereof to produce a library of recombinant polynucleotides encoding recombinant pesticidal polypeptides;

(b) screening the library to identify a recombinant polynucleotide that encodes an improved recombinant pesticidal polypeptide that has an enhanced property improved over the parental polynucleotide;

(c) recovering the recombinant polynucleotide that encodes the improved recombinant pesticidal polypeptide identified in (b); and, (d) repeating steps (a), (b) and (c) using the recombinant polynucleotide recovered in step (c) as one of the plurality of parental polynucleotides in repeated step (a).

Embodiment 29

An isolated polypeptide having insecticidal activity, comprising: (a) a polypeptide comprising an amino acid sequence selected from the group consisting of sequences set forth in SEQ ID NOs: 205, 206, 207, 208, 209, 210, 211, 212, 213, or 214, and further comprising at least 1, 2, 3, 4, 5, 6, 7, 8, 9, 10 or more of the modifications set forth in Table 3; or (b) a polypeptide comprising an amino acid sequence having at least 80%, 85%, 86%, 87%, 88%, 89%, 90%, 91%, 92%, 93%, 94%, 95%, 96%, 97%, 98%, or 99% sequence identity to any one of SEQ ID NOS: 205, 206, 207, 208, 209, 210, 211, 212, 213, or 214 and further comprising at least 1, 2, 3, 4, 5, 6, 7, 8, 9, 10, or more of the modifications set forth in Table 3.

Embodiment 30

The polypeptide of embodiment 29, wherein said polypeptide comprises the amino acid sequence set forth in SEQ ID NO:205, 206, 207, 208, 209, 210, 211, 212, 213, or 214, and further comprising at least 1, 2, 3, 4, 5, 6, 7, 8, 9, 10 or more of the modifications set forth in Table 3.

Embodiment 31

The polypeptide of embodiment 29 or 30, further comprising heterologous amino acid sequences.

Embodiment 32

A composition comprising the polypeptide of any one of embodiments 29, 30, or 31.

Embodiment 33

A recombinant nucleic acid molecule that encodes the polypeptide of any one of embodiments 1 to 3, wherein said recombinant nucleic acid molecule is not the naturally occurring sequence encoding said polypeptide.

Embodiment 34

The recombinant nucleic acid of embodiment 33, wherein said nucleic acid molecule is a synthetic sequence that has been designed for expression in a plant.

Embodiment 35

The recombinant nucleic acid molecule of embodiment 33 or 34, wherein said nucleic acid molecule is operably linked to a promoter capable of directing expression in a plant cell.

Embodiment 36

The recombinant nucleic acid molecule of any one of embodiments 33, 34, or 35, wherein said nucleic acid molecule is operably linked to a promoter capable of directing expression in a bacteria.

Embodiment 37

A host cell that contains the recombinant nucleic acid molecule of any one of embodiments 33, 34, 35 or 36.

Embodiment 38

The host cell of embodiment 37, wherein said host cell is a bacterial host cell.

Embodiment 39

A DNA construct comprising a promoter that drives expression in a plant cell operably linked to a recombinant nucleic acid molecule comprising: (a) a nucleotide sequence that encodes a polypeptide, wherein the polypeptide comprises the amino acid sequence of any one of SEQ ID NOS:205, 206, 207, 208, 209, 210, 211, 212, 213, or 214, and further comprises at least 1, 2, 3, 4, 5, 6, 7, 8, 9, 10 or more of the modifications set forth in Table 3; or (b) a nucleotide sequence that encodes a polypeptide, wherein the polypeptide comprises an amino acid sequence having at least 80%, 85%, 86%, 87%, 88%, 89%, 90%, 91%, 92%, 93%, 94%, 95%, 96%, 97%, 98%, or 99% sequence identity to any one of SEQ ID NOS: 205, 206, 207, 208, 209, 210, 211, 212, 213, or 214 and further comprises at least 1, 2, 3, 4, 5, 6, 7, 8, 9, 10, or more of the modifications set forth in Table 3.

Embodiment 40

The DNA construct of embodiment 39, wherein said nucleotide sequence is a synthetic DNA sequence that has been designed for expression in a plant.

Embodiment 41

A vector comprising the DNA construct of embodiment 39 or 40.

Embodiment 42

A host cell that contains the DNA construct of any one of embodiments 39, 40 or 41 or the vector of embodiment 41.

Embodiment 43

The host cell of embodiment 42, wherein the host cell is a plant cell.

Embodiment 44

A transgenic plant comprising the host cell of embodiment 42 or 43.

Embodiment 45

A composition comprising the host cell of any one of embodiments 37, 38, 42 or 43.

Embodiment 46

The composition of embodiment 45, wherein said composition is selected from the group consisting of a powder, dust, pellet, granule, spray, emulsion, colloid, and solution.

Embodiment 47

The composition of embodiment 45 or 46, wherein said composition comprises from about 1% to about 99% by weight of said polypeptide.

Embodiment 48

A method for controlling a pest population comprising contacting said population with a pesticidal-effective amount of the composition of any one of embodiments 32 or 45-47.

Embodiment 49

A method for killing a pest population comprising contacting said population with a pesticidal-effective amount of the composition of any one of embodiments 32 or 45-47.

Embodiment 50

A method for producing a polypeptide with pesticidal activity, comprising culturing the host cell of any one of embodiments 37, 38, 42, or 43 under conditions in which the nucleic acid molecule encoding the polypeptide is expressed.

Embodiment 51

A plant having stably incorporated into its genome a DNA construct comprising a nucleotide sequence that encodes a protein having pesticidal activity, wherein said nucleotide sequence comprises: (a) a nucleotide sequence that encodes a polypeptide, wherein the polypeptide comprises the amino acid sequence of any one of SEQ ID NOS: 205, 206, 207, 208, 209, 210, 211, 212, 213, or 214, and further comprises at least 1, 2, 3, 4, 5, 6, 7, 8, 9, 10, or more of the modifications set forth in Table 3; or (b) a nucleotide sequence that encodes a polypeptide, wherein the polypeptide comprises an amino acid sequence having at least 80%, 85%, 86%, 87%, 88%, 89%, 90%, 91%, 92%, 93%, 94%, 95%, 96%, 97%, 98%, or 99% sequence identity to any one of SEQ ID NOS: 205, 206, 207, 208, 209, 210, 211, 212, 213, or 214 and further comprises at least 1, 2, 3, 4, 5, 6, 7, 8, 9, 10, or more of the modifications set forth in Table 3.

Embodiment 52

A transgenic seed of the plant of embodiment 51.

Embodiment 53

A method for protecting a plant from an insect pest, comprising expressing in a plant or cell thereof a nucleotide sequence that encodes a pesticidal polypeptide, wherein said nucleotide sequence comprises: (a) a nucleotide sequence that encodes a polypeptide comprising the amino acid sequence of any one of SEQ ID NOS: 205, 206, 207, 208, 209, 210, 211, 212, 213, or 214, and further comprising at least 1, 2, 3, 4, 5, 6, 7, 8, 9, 10 or more of the modifications set forth in Table 3; or (b) a nucleotide sequence that encodes a polypeptide comprising an amino acid sequence having at least 80%, 85%, 86%, 87%, 88%, 89%, 90%, 91%, 92%, 93%, 94%, 95%, 96%, 97%, 98%, 99% sequence identity to any one of SEQ ID NOS: 205, 206, 207, 208, 209, 210, 211, 212, 213, or 214 and further comprising at least 1, 2, 3, 4, 5, 6, 7, 8, 9, 10, or more of the modifications set forth in Table 3.

Embodiment 54

The method of embodiment 53, wherein said plant produces a pesticidal polypeptide having pesticidal activity against a lepidopteran or coleopteran pest.

Embodiment 55

A method for increasing yield in a plant comprising growing in a field a plant or seed thereof having stably incorporated into its genome a DNA construct comprising a promoter that drives expression in a plant operably linked to a nucleotide sequence that encodes a pesticidal polypeptide, wherein said nucleotide sequence comprises: (a) a nucleotide sequence that encodes a polypeptide comprising the amino acid sequence of any one of SEQ ID NOS: 205, 206, 207, 208, 209, 210, 211, 212, 213, or 214, and further comprising at least 1, 2, 3, 4, 5, 6, 7, 8, 9, 10 or more of the modifications set forth in Table 3; or (b) a nucleotide sequence that encodes a polypeptide comprising an amino acid sequence having at least 80%, 85%, 86%, 87%, 88%, 89%, 90%, 91%, 92%, 93%, 94%, 95%, 96%, 97%, 98%, 99% sequence identity to any one of SEQ ID NOS: 205, 206, 207, 208, 209, 210, 211, 212, 213, or 214 and further comprising at least 1, 2, 3, 4, 5, 6, 7, 8, 9, 10, or more of the modifications set forth in Table 3.

Embodiment 56

A method of obtaining a polynucleotide that encodes an improved polypeptide comprising pesticidal activity is provided, wherein the improved polypeptide has at least one improved property over any one of SEQ ID NOS: 205, 206, 207, 208, 209, 210, 211, 212, 213, or 214 comprising: (a) recombining a plurality of parental polynucleotides comprising SEQ ID NO: 205, 206, 207, 208, 209, 210, 211, 212, 213, or 214 or an active variant or fragment thereof to produce a library of recombinant polynucleotides encoding recombinant pesticidal polypeptides; (b) screening the library to identify a recombinant polynucleotide that encodes an improved recombinant pesticidal polypeptide that has an enhanced property improved over the parental polynucleotide; (c) recovering the recombinant polynucleotide that encodes the improved recombinant pesticidal polypeptide identified in (b); and (d) repeating steps (a), (b) and (c) using the recombinant polynucleotide recovered in step (c) as one of the plurality of parental polynucleotides in repeated step (a).

The following examples are offered by way of illustration and not by way of limitation.

EXAMPLES

Example 1. Discovery of Novel Genes by Sequencing and DNA Analysis

Microbial cultures were grown in liquid culture in standard laboratory media. Cultures were grown to saturation (16 to 24 hours) before DNA preparation. DNA was extracted from bacterial cells by detergent lysis, followed by binding to a silica matrix and washing with an ethanol buffer. Purified DNA was eluted from the silica matrix with a mildly alkaline aqueous buffer.

DNA for sequencing was tested for purity and concentration by spectrophotometry. Sequencing libraries were prepared using the Nextera XT library preparation kit according to the manufacturer's protocol. Sequence data was generated on a HiSeq 2000 according to the Illumina HiSeq 2000 System User Guide protocol.

Sequencing reads were assembled into draft genomes using the CLC Bio Assembly Cell software package. Following assembly, gene calls were made by several methods and resulting gene sequences were interrogated to identify novel homologs of pesticidal genes. Novel genes were identified by BLAST, by domain composition, and by pairwise alignment versus a target set of pesticidal genes. A summary of such sequences is set forth in Table 1 and as in SEQ ID NOS: 1-218.

Genes identified in the homology search were amplified from bacterial DNA by PCR and cloned into bacterial expression vectors containing fused in-frame purification tags. Cloned genes were expressed in *E. coli* and purified by column chromatography. Purified proteins were assessed in insect diet bioassay studies to identify active proteins.

Example 2. Heterologous Expression in *E. Coli*

The open reading frame set forth in SEQ ID NO: 209 (APG01037.1) was cloned into an *E. coli* expression vector containing a 6×HIS tag (pHIS). The expression vector was transformed into BL21*RIPL. An LB culture supplemented with kanyamycin was inoculated with a single colony and grown overnight at 37° C. using 0.5% of the overnight culture, a fresh culture was inoculated and grown to logarithmic phase at 37 degrees C. The culture was induced using 250 mM IPTG for 18 hours at 16° C. The cells were pelleted and resuspended in 10 mM Tris pH7.4 and 150 mM NaCl supplemented with protease inhibitors. The protein expression was evaluated by SDS-PAGE.

Example 3. Pesticidal Activity Against Coleopteran and Lepidoptera

Protein Expression:

The sequence set forth in SEQ ID NO: 209 (APG01037.1) was expressed in *E. coli* as described in Example 2. 400 mL of LB was inoculated and grown to an OD600 of 0.6. The culture was induced with 250 mM IPTG overnight at 16° C. The cells were spun down and the cell pellet was resuspend in 5 mL of buffer. The resuspension was bead beaten for 2 min at 4° C.

Bioassay:

Fall army worm (FAW), corn ear worm (CEW), European corn borer (ECB) southwestern corn borer (SWCB) and diamond backed moth (DBM) eggs were purchased from a commercial insectary (Benzon Research Inc., Carlisle, Pa.). The FAW, CEW, ECB and BCW eggs were incubated to the point that eclosion would occur within 12 hrs of the assay setup. SWCB and DBM were introduced to the assay as neonate larvae. Assays were carried out in 24-well trays containing multispecies lepidopteran diet (SOUTHLAND PRODUCTS INC., Lake Village, Ark.). Samples of the bead beaten lysate were applied to the surface of the diet (diet overlay) and allowed to evaporate and soak into the diet. For CEW, FAW, BCW, ECB and SWCB, a 125 μl of bead beaten lysate was added to the diet surface and dried. For DBM, 50 μl of a 1:2 dilution of bead beaten lysate was added to the diet surface. The bioassay plates were sealed with a plate sealing film vented with pin holes. The plates were incubated at 26 C at 65% RH on a 16:8 day:night cycle in a Percival for 5 days. The assays were assessed for level of mortality, growth inhibition and feeding inhibition.

For the western corn rootworm bioassay, the protein construct/lysate was evaluated in an insect bioassay by dispensing 60 μl of a 1:6 dilution of bead beaten lysate to the top surface of diet in well/s of 24-well plate (Cellstar, 24-well, Greiner Bio One) and allowed to dry. Each well contains 500 μl diet (Marrone et al., 1985). Fifteen to twenty neonate larvae were introduced in each well using a fine tip paint brush and the plate was covered with membrane (Viewseal, Greiner Bio One). The bioassay was stored at ambient temperature and scored for mortality, and/or growth/feeding inhibition at day 4. FIG. 2 provides the assay scoring guidelines for the corn root worm bioassay.

For Colorado Potato Beetle (CPB) a cork bore size No. 8 leaf disk was excised from potato leaf and is dipped in the protein bead beaten lysate with 0.1% Tween80 until thoroughly wet and placed on top of filter disk (Millipore, glass fiber filter, 13 mm). Sixty μl dH$_2$O was added to each filter disk and placed in each well of 24-well plate (Cellstar, 24-well, Greiner Bio One). The leaf disk was allowed to dry and five to seven first instar larvae were introduced in each well using a fine tip paint brush. The plate is covered with membrane (Viewseal, Greiner Bio One) and a small hole was punctured in each well of the membrane. The construct was evaluated with four replicates, and scored for mortality and leaf damage on day 3.

The data from the various Lepidoptera bioassays is set forth in Table 4, and the scoring chart for the Lepidoptera bioassay is found in Table 5. As shown, SEQ ID NO: 209 has pesticidal activity against Lepidoptera.

TABLE 4

Pesticidal activity of SEQ ID NO: 209 (APG01037.1) against various Lepidoptera

|  | *Plutella xylostella* (Px) | Corn Earworm (CEW) | Fall Armyworm (FAW) | Black Cutworm (BCW) | Southwestern Corn Borer (SWCB) | European Corn Borer (ECB) |
|---|---|---|---|---|---|---|
| Cry1Ac | 5 | 5 | 3 | 5 | 5 | 5 |
| SEQ ID NO: 209 (APG01037.1) | 5 | 4 | 3 | 5 | 4 | 5 |
| MBP empty vector | 0 | 0 | 1 | 0 | 1 | 0 |

TABLE 5

Scoring scale for Lepidoptera bioassay

| | |
|---|---|
| 0 | no effect |
| 1 | slight stunt |
| 2 | stunt, low feeding |
| 3 | stunt, some mortality, low feeding |
| 4 | stunt, some mortality, very low feeding |
| 5 | stunt, complete mortality, very low feeding |

The data from the various Coleopteran bioassays is set forth in Table 6. The CPB assay was run using a leaf disk. The leaf disk was soaked in bead beaten lysate with 0.1% Tween 80 and then CPB was placed on the leaf to look at both mortality and feeding. The more damage to the leaf, the more feeding. APG01037.1 (SEQ ID NO: 209) had 100% mortality with 2% leaf damage in the CPB bioassay. Data not shown. Negative controls (Buffer and empty vector) had 0% mortality with 65% and 70% leaf damage respectively. This demonstrates APG01037.1 SEQ ID NO: 209 has pesticidal activity against coleopteran.

Data from the corn root worm bioassay is set forth in Table 6. As shown, APG01037.1 (SEQ ID NO: 209) had 100% mortality and negative controls (Cry1Ac, MBP empty vector and buffer) had less than 10% mortality. This demonstrates APG01037.1 SEQ ID NO: 209 has pesticidal activity against Coleopteran.

TABLE 6

Corn Root Worm Bioassay

| APG# | % Mortality | CRW Larva size |
|---|---|---|
| APG01037.1 (SEQ ID NO: 209) | 100 | s, m |
| Buffer | 10 | b |
| MBP empty vector | 6 | b |
| Diet | 14 | b |

CRW larva size: big (b), medium (m), and small (s)

Example 4. Pesticidal Activity Against Hemipteran

Protein Expression:

The sequence set forth is SEQ ID NO: 209 was expressed in E. coli as described in Example 2. 400 mL of LB was inoculated and grown to an OD600 of 0.6. The culture was induced with 0.25 mM IPTG overnight at 16 C. The cells were spun down and the cell pellet is re-suspend in 5 mL of buffer. The resuspension was bead beaten for 2 min on ice.

Second instar SGSB were obtained from a commercial insectary (Benzon Research Inc., Carlisle, Pa.). A 50% v/v ratio of bead beaten lysate sample to 20% sucrose was employed in the bioassay. Stretched parafilm was used as a feeding membrane to expose the SGSB to the diet/sample mixture. The plates were incubated at 25 C:21 C, 16:8 day:night cycle at 65% RH for 5 days.

Mortality is scored for each sample. The controls (MPB empty vector and buffer) showed 0% mortality. The sample containing SEQ ID NO: 209 (APG01037.1) resulted in 100% mortality of the SGSB.

Example 5. Heterologous Expression in E. Coli

Each open reading frame set forth in SEQ ID NO: 205, 206, 207, 208, 209 or active variants or fragments thereof or an open reading frame set forth in Table 1 (SEQ ID NO: 1-204 and SEQ ID NOS: 205-218) or an active variant or fragment thereof was cloned into an E. coli expression vector containing a 6×HIS tag (pHIS). The expression vector was transformed into BL21*RIPL. An LB culture supplemented with kanamycin was inoculated with a single colony and grown overnight at 37 degrees C. using 0.5% of the overnight culture, a fresh culture was inoculated and grown to logarithmic phase at 37 degrees C. The culture was induced using 250 mM IPTG for 18 hours at 16 degrees C. The cells were pelleted and resuspended in 10 mM Tris pH7.4 and 150 mM NaCl supplemented with protease inhibitors. The protein expression was evaluated by SDS-PAGE.

Example 6. Pesticidal Activity Against Coleopteran and Lepidoptera

Protein Expression:

Each of SEQ ID NO: 205, 206, 207, 208, 209 or active variants or fragments thereof or an open reading frame set forth in sequence set forth in Table 1 (SEQ ID NO: 1-218) is expressed in E. coli as described in Example 5. 400 mL of LB is inoculated and grown to an OD600 of 0.6. The culture is induced with 0.25 mM IPTG overnight at 16 C. The cells are spun down and the cell pellet is resuspend in 5 mL of buffer. The resuspension is bead beaten for 2 min at 4 degrees C.

Bioassay:

Fall army worm (FAW), corn ear worm (CEW), European corn borer (ECB) southwestern corn borer (SWCB) and diamond backed moth (DBM) eggs are purchased from a commercial insectary (Benzon Research Inc., Carlisle, Pa.). The FAW, CEW, ECB and BCW eggs are incubated to the point that eclosion would occur within 12 hrs of the assay setup. SWCB and DBM are introduced to the assay as neonate larvae. Assays are carried out in 24-well trays containing multispecies lepidopteran diet (SOUTHLAND PRODUCTS INCORPORATED, Lake Village, Ark.). Samples of the sonicated lysate are applied to the surface of the diet (diet overlay) and allowed to evaporate and soak into the diet. For CEW, FAW, BCW, ECB and SWCB, a 125 µl of sonicated lysate is added to the diet surface and dried. For DBM, 50 µl of a 1:2 dilution of sonicated lysate was added to the diet surface. The bioassay plates are sealed with a plate sealing film vented with pin holes. The plates are incubated at 26 C at 65% RH on a 16:8 day:night cycle in a Percival for 5 days. The assays are assessed for level of mortality, growth inhibition and feeding inhibition.

For the western corn rootworm bioassay, the protein construct/lysate is evaluated as set forth in Example 3. FIG. 2 provides the assay scoring guidelines for the corn root worm bioassay.

For Colorado Potato Beetle (CPB), the protein construct/lysate is evaluated as set forth in Example 3.

Example 7. Pesticidal Activity Against Hemipteran

Protein Expression:

Each of the sequences of SEQ ID NO: 205, 206, 207, 208, 209 or active variants or fragments thereof or an open reading frame set forth in set forth in Table 1 (SEQ ID NO: 1-218) is expressed in E. coli as described in Example 5. 400 mL of LB is inoculated and grown to an OD600 of 0.6. The culture is induced with 250 mM IPTG overnight at 16 C. The cells are spun down and the cell pellet is re-suspend in 5 mL of buffer. The resuspension is bead beaten for 2 min at 4 degree C.

Second instar SGSB are obtained from a commercial insectary (Benzon Research Inc., Carlisle, Pa.). A 50% v/v ratio of bead beaten lysate sample to 20% sucrose is employed in the bioassay. Stretched parafilm is used as a feeding membrane to expose the SGSB to the diet/sample mixture. The plates are incubated at 25 C:21 C, 16:8 day:night cycle at 65% RH for 5 days.

Mortality is scored for each sample.

Example 8. Transformation of Soybean

DNA constructs comprising SEQ ID NO: 205, 206, 207, 208, 209 or an active variant of fragment thereof or each of SEQ ID NOS: 1-218 or active variants or fragments thereof operably linked to a promoter active in a plant are cloned into transformation vectors and introduced into *Agrobacterium* as described in U.S. Provisional Application No. 62/094,782, filed Dec. 19, 2015, herein incorporated by reference in its entirety.

Four days prior to inoculation, several loops of *Agrobacterium* are streaked to a fresh plate of YEP* medium supplemented with the appropriate antibiotics** (spectinomycin, chloramphenicol and kanamycin). Bacteria are grown for two days in the dark at 28 C. After two days, several loops of bacteria are transferred to 3 ml of YEP liquid medium with antibiotics in a 125 ml Erlenmeyer flask. Flasks are placed on a rotary shaker at 250 RPM at 28 C overnight. One day before inoculation, 2-3 ml of the overnight culture were transferred to 125 ml of YEP with antibiotics in a 500 ml Erlenmeyer flask. Flasks are placed on a rotary shaker at 250 RPM at 28 C overnight.

Prior to inoculation, the OD of the bacterial culture is checked at OD 620. An OD of 0.8-1.0 indicates that the culture is in log phase. The culture is centrifuged at 4000 RPM for 10 minutes in Oakridge tubes. The supernatant is discarded and the pellet is resuspended in a volume of Soybean Infection Medium (SI) to achieve the desired OD. The cultures are held with periodic mixing until needed for inoculation.

Two or three days prior to inoculation, soybean seeds are surface sterilized using chlorine gas. In a fume hood, a petri dish with seeds is place in a bell jar with the lid off. 1.75 ml of 12 N HCl is slowly added to 100 ml of bleach in a 250 ml Erlenmeyer flask inside the bell jar. The lid is immediately placed on top of the bell jar. Seeds are allowed to sterilize for 14-16 hours (overnight). The top is removed from the bell jar and the lid of the petri dish is replaced. The petri dish with the surface sterilized is then opened in a laminar flow for around 30 minutes to disperse any remaining chlorine gas.

Seeds are imbibed with either sterile DI water or soybean infection medium (SI) for 1-2 days. Twenty to 30 seeds are covered with liquid in a 100×25 mm petri dish and incubated in the dark at 24 C. After imbibition, non-germinating seeds are discarded.

Cotyledonary explants is processed on a sterile paper plate with sterile filter paper dampened using SI medium employing the methods of U.S. Pat. No. 7,473,822, herein incorporated by reference.

Typically, 16-20 cotyledons are inoculated per treatment. The SI medium used for holding the explants is discarded and replaced with 25 ml of *Agrobacterium* culture (OD 620=0.8-20). After all explants are submerged, the inoculation is carried out for 30 minutes with periodic swirling of the dish. After 30 minutes, the *Agrobacterium* culture is removed.

Co-cultivation plates is prepared by overlaying one piece of sterile paper onto Soybean Co-cultivation Medium (SCC). Without blotting, the inoculated cotyledons is cultured adaxial side down on the filter paper. Around 20 explants can be cultured on each plate. The plates are sealed with Parafilm and cultured at 24 C and around 120 umoles m-2s-1 (in a Percival incubator) for 4-5 days.

After co-cultivation, the cotyledons are washed 3 times in 25 ml of Soybean Wash Medium with 200 mg/l of cefotaxime and timentin. The cotyledons are blotted on sterile filter paper and then transferred to Soybean Shoot Induction Medium (SSI). The nodal end of the explant is depressed slightly into the medium with distal end kept above the surface at about 45 deg. No more than 10 explants are cultured on each plate. The plates are wrapped with Micropore tape and cultured in the Percival at 24 C and around 120 umoles m-2s-1.

The explants are transferred to fresh SSI medium after 14 days. Emerging shoots from the shoot apex and cotyledonary node are discarded. Shoot induction is continued for another 14 days under the same conditions.

After 4 weeks of shoot induction, the cotyledon is separated from the nodal end and a parallel cut is made underneath the area of shoot induction (shoot pad). The area of the parallel cut is placed on Soybean Shoot Elongation Medium (SSE) and the explants cultured in the Percival at 24 C and around 120 umoles m-2s-1. This step is repeated every two weeks for up to 8 weeks as long as shoots continue to elongate.

When shoots reach a length of 2-3 cm, they are transferred to Soybean Rooting Medium (SR) in a Plantcon vessel and incubated under the same conditions for 2 weeks or until roots reach a length of around 3-4 cm. After this, plants are transferred to soil.

Note, all media mentioned for soybean transformation are found in Paz et al. (2010) *Agrobacterium*-mediated transformation of soybean and recovery of transgenic soybean plants; Plant Transformation Facility of Iowa State University, which is herein incorporated by reference in its entirety. (See, agron-www.agron.iastate.edu/ptf/protocol/Soybean.pdf.)

Example 9. Transformation of Maize

Maize ears are best collected 8-12 days after pollination. Embryos are isolated from the ears, and those embryos 0.8-1.5 mm in size are preferred for use in transformation. Embryos are plated scutellum side-up on a suitable incubation media, such as DN62A5S media (3.98 g/L N6 Salts; 1 mL/L (of 1000.times. Stock) N6 Vitamins; 800 mg/L L-Asparagine; 100 mg/L Myo-inositol; 1.4 g/L L-Proline; 100 mg/L Casamino acids; 50 g/L sucrose; 1 mL/L (of 1 mg/mL Stock) 2,4-D). However, media and salts other than DN62A5S are suitable and are known in the art. Embryos are incubated overnight at 25 degree C. in the dark. However, it is not necessary per se to incubate the embryos overnight.

The resulting explants are transferred to mesh squares (30-40 per plate), transferred onto osmotic media for about 30-45 minutes, then transferred to a beaming plate (see, for example, PCT Publication No. WO/0138514 and U.S. Pat. No. 5,240,842). DNA constructs designed to express the proteins set forth SEQ ID NO: 205, 206, 207, 208, 209 or the proteins set forth in Table 1 (SEQ ID NO: 1-218) in plant cells are accelerated into plant tissue using an aerosol beam accelerator, using conditions essentially as described in PCT Publication No. WO/0138514. After beaming, embryos are incubated for about 30 min on osmotic media, and placed onto incubation media overnight at 25 degree C. in the dark. To avoid unduly damaging beamed explants, they are incubated for at least 24 hours prior to transfer to recovery media. Embryos are then spread onto recovery period media, for about 5 days, 25 degree C. in the dark, then transferred to a selection media. Explants are incubated in selection media for up to eight weeks, depending on the nature and characteristics of the particular selection utilized. After the selection period, the resulting callus is transferred to embryo maturation media, until the formation of mature somatic embryos is observed. The resulting mature somatic embryos are then placed under low light, and the process of regeneration is initiated by methods known in the art. The resulting shoots are allowed to root on rooting media, and the resulting plants are transferred to nursery pots and propagated as transgenic plants.

Example 10. Pesticidal Activity Against Nematodes

A. *Heterodera* Glycine's (Soybean Cyst Nematode) In-Vitro Assay.

Soybean Cyst Nematodes are dispensed into a 96 well assay plate with a total volume of 100 uls and 100 J2 per well. The protein of interest as set forth in SEQ ID NO: 205, 206, 207, 208, 209 or active variant or fragments thereof or the sequences set forth in Table 1 (any one of SEQ ID NOS: 1-218) is dispensed into the wells and held at room temperature for assessment. Finally the 96 well plate containing the SCN J2 is analyzed for motility. Data is reported as % inhibition as compared to the controls. Hits are defined as greater or equal to 70% inhibition.

B. *Heterodera* Glycine's (Soybean Cyst Nematode) On-Plant Assay

Soybean plants expressing one or more of SEQ ID NO: 205, 206, 207, 208, 209 or active variant or fragments thereof or the sequences set forth in SEQ ID NO: 1-218 or active variant or fragment thereof are generated as described elsewhere herein. A 3-week-old soybean cutting is inoculated with 5000 SCN eggs per plant. This infection is held for 70 days and then harvested for counting of SCN cyst that has developed on the plant. Data is reported as % inhibition as compared to the controls. Hits are defined as greater or equal to 90% inhibition.

C. *Meloidogyne incognita* (Root-Knot Nematode) In-Vitro Assay

Root-Knot Nematodes are dispensed into a 96 well assay plate with a total volume of 100 uls and 100 J2 per well. The protein of interest comprising any one of SEQ ID NO: 205, 206, 207, 208, 209 or active variant or fragments thereof or the sequences set forth in SEQ ID NO: 1-218 or active variant or fragment thereof is dispensed into the wells and held at room temperature for assessment. Finally the 96 well plate containing the RKN J2 is analyzed for motility. Data is reported as % inhibition as compared to the controls. Hits are defined as greater or equal to 70% inhibition.

D. *Meloidogyne incognita* (Root-Knot Nematode) On-Plant Assay

Soybean plants expressing one or more of SEQ ID NO: 205, 206, 207, 208, 209 or active variant or fragments thereof or the sequences set forth in SEQ ID NO: 1-218 or active variants or fragments thereof are generated as described elsewhere herein. A 3-week-old soybean is inoculated with 5000 RKN eggs per plant. This infection is held for 70 days and then harvested for counting of RKN eggs that have developed in the plant. Data is reported as % inhibition as compared to the controls. Hits are defined as greater or equal to 90% inhibition.

Example 11. Additional Assays for Pesticidal Activity

The various polypeptides set forth in SEQ ID NO: 205, 206, 207, 208, 209 or active variant or fragments thereof or the sequences set forth in SEQ ID NO: 1-218 or active variant or fragment thereof can be tested to act as a pesticide upon a pest in a number of ways. One such method is to perform a feeding assay. In such a feeding assay, one exposes the pest to a sample containing either compounds to be tested or control samples. Often this is performed by placing the material to be tested, or a suitable dilution of such material, onto a material that the pest will ingest, such as an artificial diet. The material to be tested may be composed of a liquid, solid, or slurry. The material to be tested may be placed upon the surface and then allowed to dry. Alternatively, the material to be tested may be mixed with a molten artificial diet, and then dispensed into the assay chamber. The assay chamber may be, for example, a cup, a dish, or a well of a microtiter plate.

Assays for sucking pests (for example aphids) may involve separating the test material from the insect by a partition, ideally a portion that can be pierced by the sucking mouth parts of the sucking insect, to allow ingestion of the test material. Often the test material is mixed with a feeding stimulant, such as sucrose, to promote ingestion of the test compound.

Other types of assays can include microinjection of the test material into the mouth, or gut of the pest, as well as development of transgenic plants, followed by test of the ability of the pest to feed upon the transgenic plant. Plant testing may involve isolation of the plant parts normally consumed, for example, small cages attached to a leaf, or isolation of entire plants in cages containing insects.

Other methods and approaches to assay pests are known in the art, and can be found, for example in Robertson and Preisler, eds. (1992) Pesticide bioassays with arthropods, CRC, Boca Raton, Fla. Alternatively, assays are commonly described in the journals Arthropod Management Tests and Journal of Economic Entomology or by discussion with members of the Entomological Society of America (ESA). Any one of SEQ ID NO: 205, 206, 207, 208, 209 or active variant or fragments thereof or the sequences set forth in SEQ ID NOS: 1-218 or active variant or fragment thereof can be expressed and employed in an assay as set forth herein.

Example 12. Pesticidal Activity Against Coleopteran and Lepidoptera

Protein Expression: Each sequence set forth in Table 7 was expressed in *E. coli* as described in Example 2. 400 mL of LB was inoculated and grown to an OD600 of 0.6. The culture was induced with 0.25 mM IPTG overnight at 16° C. The cells were spun down and the cell pellet was resuspend in 5 mL of buffer. The resuspension was sonicated for 2 min on ice.

Bioassay: Fall armyworm (FAW), corn earworm (CEW), European corn borer (ECB) southwestern corn borer (SWCB) and diamond backed moth (DBM or Px) bioassays were performed as described in Example 6.

For the western corn rootworm bioassay, the protein construct/lysate was evaluated as described in Example 3. For Colorado Potato Beetle (CPB), the protein construct/lysate was evaluated as described in Example 3.

Table 7 provides a summary of pesticidal activity against coleopteran and lepidoptera of the various sequences. Table code: "−" indicates no activity seen; "+" indicates pesticidal activity; "NT" indicates not tested; "S" indicates stunt; "SS" indicates slight stunt; "LF" indicates low feeding, "M" indicates mortality.

TABLE 7

| | | | | | | | | | |
|---|---|---|---|---|---|---|---|---|---|
| Summary of Pesticidal Activity against Coleopteran and Lepidoptera. | | | | | | | | | |
| APG | Seq ID | FAW | CEW | BCW | ECB | SWCB | CPB | Px | WCR Mortality (%) |
| APG01037.1 | 209 | + | + | + | + | + | + | + | 100 |
| APG00623.0 | 207 | + | + | + | + | + | + | + | 100 |
| APG00556.1 | 206 | + | + | + | + | + | + | + | 100 |
| APG01037.4 | 210 | + | + | + | + | + | + | + | 100 |
| APG01037.5 | 211 | + | + | + | + | + | + | + | 100 |
| APG01037.6 | 212 | + | + | + | + | + | + | + | 100 |
| APG01037.7 | 213 | + | + | + | + | + | + | + | 100 |
| APG01037.8 | 214 | + | + | + | + | + | + | + | 100 |

Example 13. Pesticidal Activity Against Hemipteran

Protein Expression: Each of the sequences set forth in Table 8 was expressed in E. coli as described in Example 2. 400 mL of LB was inoculated and grown to an OD600 of 0.6. The culture was induced with 0.25 mM IPTG overnight at 16° C. The cells were spun down and the cell pellet was re-suspend in 5 mL of buffer. The resuspension was sonicated for 2 min on ice.

Bioassay: Second instar SGSB, brown sting bugs (BSB) and brown marmorated stink bugs (BMSB) were obtained from ABI's insectary. A 50% v/v ratio of sonicated lysate sample to 20% sucrose solution was employed in the bioassay. Stretched parafilm was used as a feeding membrane to expose the SBs to the diet/sample mixture. The plates were incubated at 25° C.: 21° C., 16:8 day:night cycle at 65% RH for 7 days.

Mortality was scored for each sample. The results are set forth in Table 8. A dashed line indicates no mortality was detected. The negative controls (empty vector expressed binding domain and buffer only) both showed no mortality (0 stinkbugs out of 4).

TABLE 8

Summary of Pesticidal Activity against Hemipteran

| APG | Seq ID | SGSB (% mortality) | BSB (% mortality) | BMSB (% mortality) |
|---|---|---|---|---|
| APG01037.1 | 209 | 100 | 100 | 100 |
| APG00623.0 | 207 | 100 | NT | NT |
| APG00556.1 | 206 | 100 | NT | NT |
| APG01037.4 | 210 | 100 | NT | NT |
| APG01037.5 | 211 | 100 | 100 | 100 |
| APG01037.6 | 212 | 100 | NT | NT |
| APG01037.7 | 213 | 100 | NT | NT |
| APG01037.8 | 214 | 100 | NT | NT |

Example 14. Time Course Assay of APG01037.1 (SEQ ID NO: 209) Against Southern Green Stink Bugs Twenty-four second instar SGSB were exposed to 250 ppm APG01037.1 (SEQ ID NO: 209) at 50% v/v ratio of purified protein in 20% sucrose as described in Example 13. Assays were scored for mortality on days 4 through 10. At day 7, mortality was 50% higher than the control. FIG. 3 provides the results of the time course assay of APG01037.1 (SEQ ID NO: 209) against SGSB.

Figure 4:
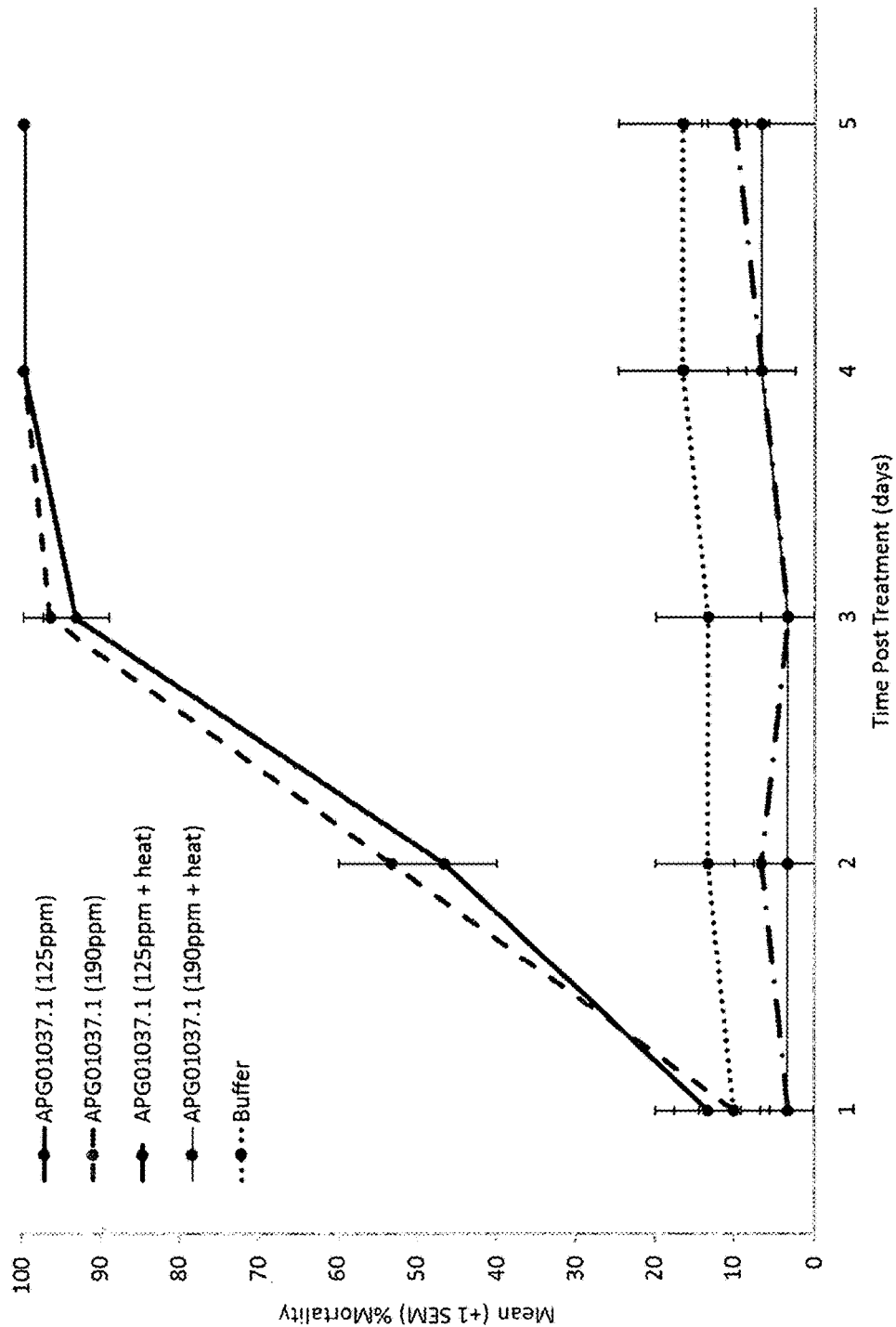
FIG. 4 provides the results of the time course assay of APG01037.1 (SEQ ID NO: 209) against Soybean Aphids.

Example 15. Time Course Assay of APG01037.1 (SEQ ID NO: 209) Against Soybean Aphids Five SBA were introduced to each well of a 24-well plate using a paint brush. A membrane was placed over the well and pushed into place with an orifice reducer. APG01037.1 (SEQ ID NO: 209) was pipetted into each orifice reducer through the top opening at a rate of 25% (50 µl sample+150 µl artificial diet). Orifice reducers are sealed using a breathe easy membrane and a yellow plate lid is placed on top of the plate. Reproduction, adult mortality, and honeydew production were recorded on days 1 through 5 post-treatment. The protein was tested at 125 ppm and 190 ppm. At day 3, mortality was at least 80% higher than the control in both concentrations of the protein. FIG. 4 provides the results of the time course assay of APG01037.1 against Soybean Aphids.

Figure 5:
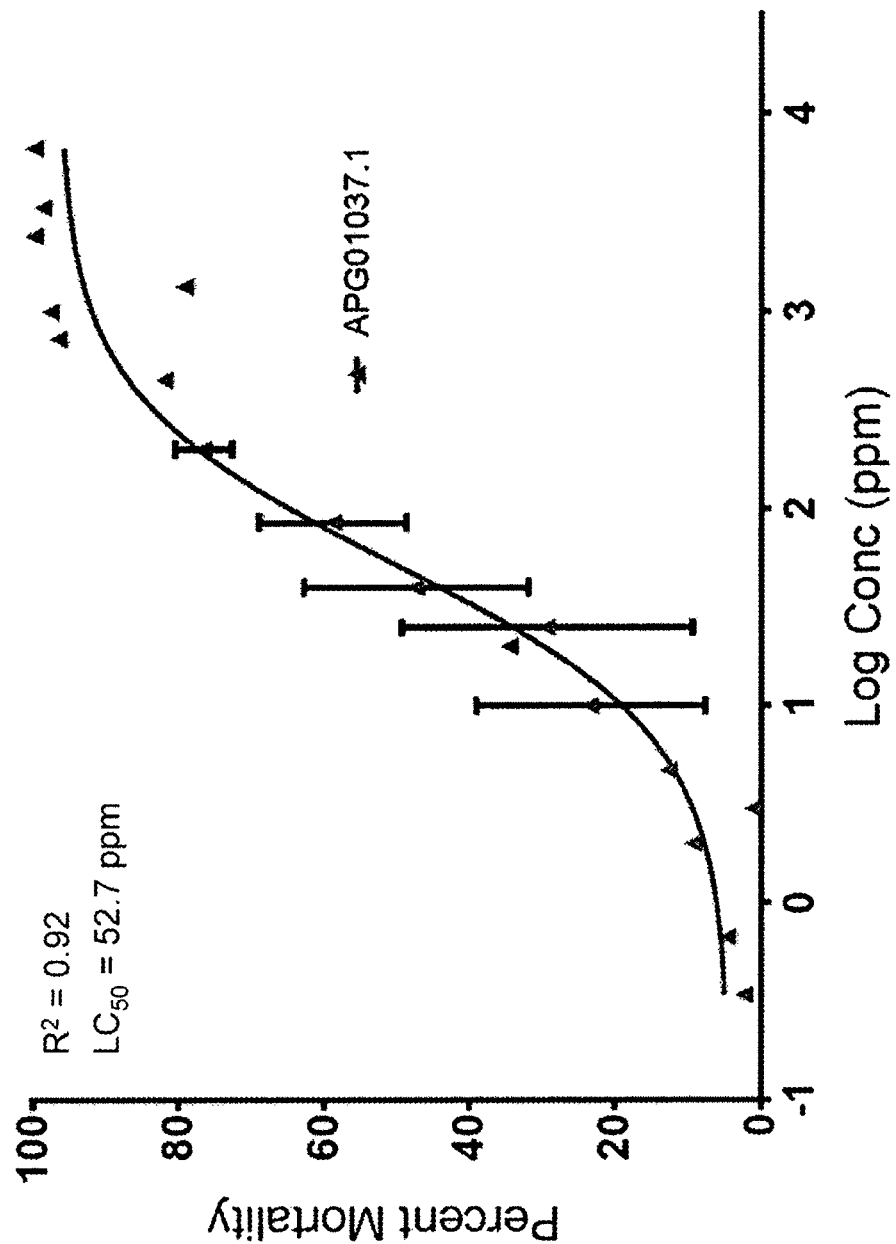
FIG. 5 provides the concentration-response curve of APG01037.1 (SEQ ID NO: 209) against Western Corn Rootworm.

Example 16. Dose-Response Assay of APG01037.1 (SEQ ID NO: 209) Against Western Corn Rootworm Approximately 50 WCR neonate larvae were exposed to different doses of APG01037.1 (SEQ ID NO: 209) in the bioassay setup as described in Example 12. The assay was scored at day 5 for mortality. Dose effects were observed. A probit analysis was performed. The LC50 was 52.7 ppm. FIG. 5 provides the concentration-response curve of APG01037.1 (SEQ ID NO: 209) against Western Corn Rootworm.

Figure 6:
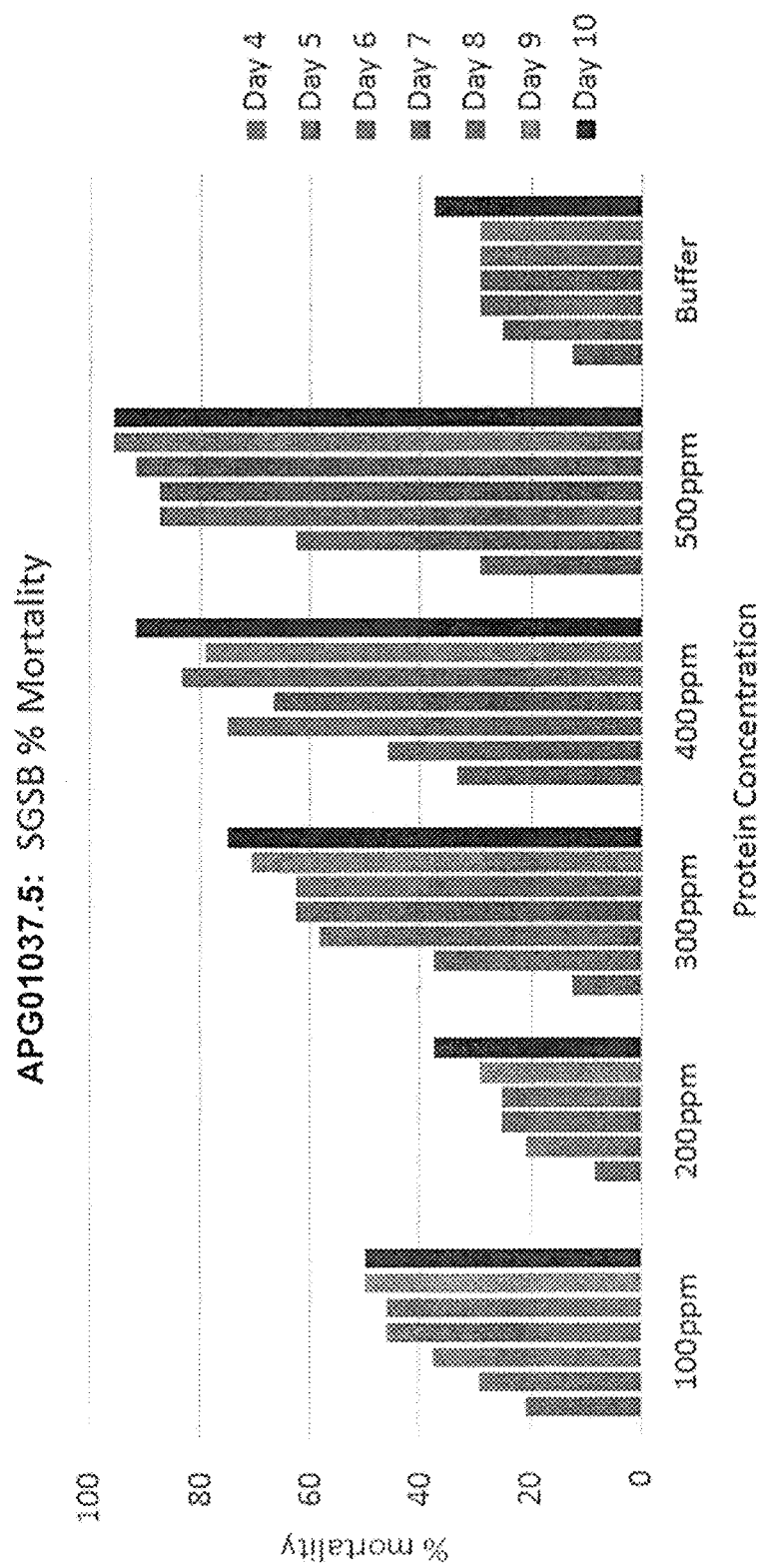
FIG. 6 provides the results of the time course assay of APG01037.5 (SEQ ID NO: 211) against SGSB.

Example 17. Dose-Response Assay of APG01037.5 (SEQ ID NO: 211) Against Southern Green Stink Bug Twenty-four second instar SGSB were exposed to different dose of purified APG01037.5 (SEQ ID NO: 211) diluted in 20% sucrose (50% v:v) using the assay format described in Example 13. Assays were scored for mortality on days 5 through 10. Dose effects were observed. FIG. 6 provides the results of the time course assay of APG01037.5 (SEQ ID NO: 211) against SGSB.

Example 18. Pesticidal Activity of APG1037.4-.8 (SEQ ID NOS: 210, 211, 212, 213, and 214) Against *Lygus*

Bioassay: *Lygus* eggs were obtained from Ova the Hill Insectary, Columbia, Mo. The eggs were incubated to the point that eclosion would occur within 12 hrs of the assay setup. Five to seven eggs were placed into the assay and a 20% v/v ratio of purified protein to diet was employed in the bioassay. Stretched parafilm was used as a feeding membrane to expose the *lygus* to the sample/diet mixture. The plates were incubated at 25° C.: 21° C., 16:8 day:night cycle at 65% RH for 5 days.

Figure 7:
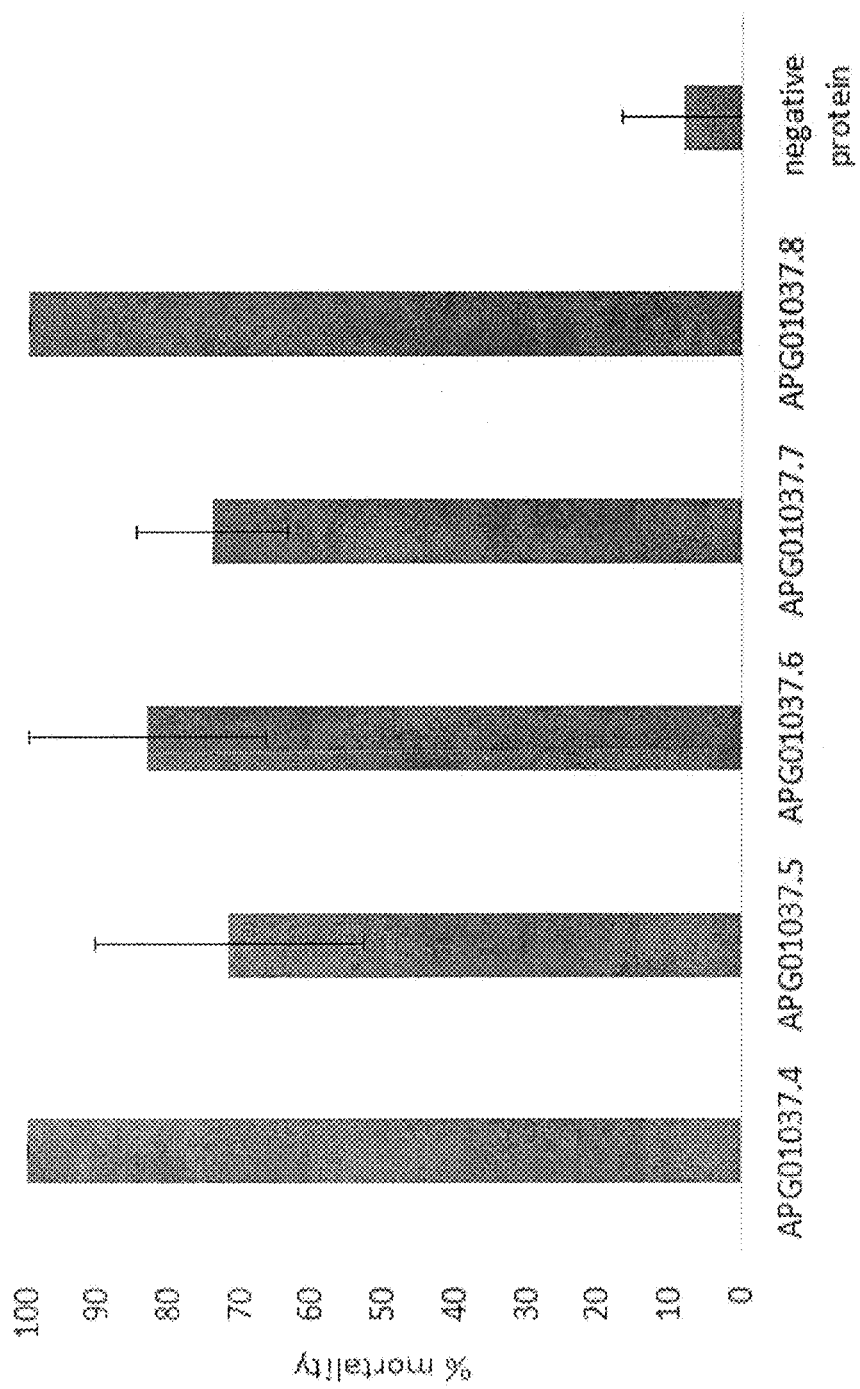
FIG. 7 shows APG1037.4-8 (SEQ ID NO: 210, 211, 212, 213, and 214) had mortality greater than 70% mortality against *Lygus*.

Mortality was scored for each sample. APG1037.4-8 (SEQ ID NO: 210, 211, 212, 213, and 214) had mortality greater than 70% mortality. The results are set forth in FIG. 7.

Example 19. Dose-Response Assay of APG1037.5 Against Fall Armyworm

Newly hatched FAW was introduced to purified APG1037.5 (SEQ ID NO: 211) through diet overlay bioassay as set forth in Example 12. Due to cannibalism only 2 larvae were placed in each well for testing. The assay was scored for mortality, growth inhibition and feeding inhibition. Activity was observed at 300 ppm and greater. The results are set forth in Table 9.

TABLE 9

Dose response APG01037.5 (SEQ ID NO: 211) against Fall armyworm

| Protein dose (ug/cm^2) | % Mortality | Mortality rating | Stunting rating |
|---|---|---|---|
| 250 | 0 | 0 | 0 |
| 300 | 75 | 2 | 1 |
| 305 | 75 | 2 | 1 |
| 310 | 67 | 2 | 2 |
| 315 | 100 | 2 | 2 |
| Buffer | 0 | 0 | 0 |

Example 20. Pesticidal Activity Against Coleopteran and Lepidoptera

Protein Expression:
The sequence set forth in SEQ ID NO: 1-218 were expressed in *E. coli* as described in Example 2. 400 mL of LB was inoculated and grown to an OD600 of 0.6. The culture was induced with 250 mM IPTG overnight at 16 C. The cells were spun down and the cell pellet was resuspend in 5 mL of buffer. The resuspension was bead beaten for 2 min at 4 degrees C.

Bioassay:
Fall army worm (FAW), corn ear worm (CEW), European corn borer (ECB) southwestern corn borer (SWCB) and diamond backed moth (DBM) eggs were purchased from a commercial insectary (Benzon Research Inc., Carlisle, Pa.). The FAW, CEW, ECB and BCW eggs were incubated to the point that eclosion would occur within 12 hrs of the assay setup. SWCB and DBM were introduced to the assay as neonate larvae. Assays were carried out in 24-well trays containing multispecies lepidopteran diet (SOUTHLAND PRODUCTS INC., Lake Village, Ark.). Samples of the bead beaten lysate were applied to the surface of the diet (diet overlay) and allowed to evaporate and soak into the diet. For CEW, FAW, BCW, ECB and SWCB, a 125 µl of bead beaten lysate was added to the diet surface and dried. For DBM, 50 µl of a 1:2 dilution of bead beaten lysate was added to the diet surface. The bioassay plates were sealed with a plate sealing film vented with pin holes. The plates were incubated at 26 C at 65% RH on a 16:8 day:night cycle in a Percival for 5 days. The assays were assessed for level of mortality, growth inhibition and feeding inhibition.

For the western corn rootworm bioassay, the protein construct/lysate was evaluated in an insect bioassay by dispensing 60 µl of a 1:6 dilution of bead beaten lysate to the top surface of diet in well/s of 24-well plate (Cellstar, 24-well, Greiner Bio One) and allowed to dry. Each well contains 500 µl diet (Marrone et al., 1985). Fifteen to twenty neonate larvae were introduced in each well using a fine tip paint brush and the plate was covered with membrane (Viewseal, Greiner Bio One). The bioassay was stored at ambient temperature and scored for mortality, and/or growth/feeding inhibition at day 4. FIG. 2 provides the assay scoring guidelines for the corn root worm bioassay.

For Colorado Potato Beetle (CPB) a cork bore size No. 8 leaf disk was excised from potato leaf and is dipped in the protein bead beaten lysate with 0.1% Tween80 until thoroughly wet and placed on top of filter disk (Millipore, glass fiber filter, 13 mm). Sixty µl dH$_2$O was added to each filter disk and placed in each well of 24-well plate (Cellstar, 24-well, Greiner Bio One). The leaf disk was allowed to dry and five to seven first instar larvae were introduced in each well using a fine tip paint brush. The plate is covered with membrane (Viewseal, Greiner Bio One) and a small hole was punctured in each well of the membrane. The construct was evaluated with four replicates, and scored for mortality and leaf damage on day 3.

The data from the various Lepidoptera and Coleopteran bioassays is set forth in Table 10, and the scoring chart for the Lepidoptera bioassay is found in Table 11. As shown, SEQ ID NO: 209 has pesticidal activity against Lepidoptera.

TABLE 10

Pesticidal activity of the SEQ ID NOS against various Lepidoptera and Coleopterans.

| APG | Seq ID | FAW | CEW | BCW | ECB | SWCB | CPB | Px | WCR Mortality (%) |
|---|---|---|---|---|---|---|---|---|---|
| APG00524.1 | Seq ID 18 | M, SS | — | — | NT | NT | NT | NT | — |
| APG00606.2 | Seq ID 52 | — | — | SS | NT | NT | NT | NT | — |
| APG00785.1 | Seq ID 151 | M,SS | — | SS | NT | NT | NT | NT | — |
| APG00785.2 | Seq ID 152 | M,SS | — | SS | NT | NT | NT | NT | — |
| APG00864.0 | Seq ID 174 | SS | — | SS | NT | NT | NT | NT | — |
| APG00607.0 | Seq ID 54 | M,SS | — | SS | NT | NT | NT | NT | — |
| APG00784.1 | Seq ID 149 | HM,S | — | SS | NT | NT | NT | NT | — |
| APG00960.2 | Seq ID 181 | M,SS | — | SS | NT | NT | NT | NT | — |
| APG00608.1 | Seq ID 56 | SS | — | — | NT | NT | NT | NT | — |

TABLE 10-continued

Pesticidal activity of the SEQ ID NOS against various Lepidoptera and Coleopterans.

| APG | Seq ID | FAW | CEW | BCW | ECB | SWCB | CPB | Px | WCR Mortality (%) |
|---|---|---|---|---|---|---|---|---|---|
| APG00534.1 | Seq ID 23 | SS | — | SS | NT | NT | NT | NT | — |
| APG00537.1 | Seq ID 29 | M,SS | — | SS | NT | NT | NT | NT | — |
| APG00786.1 | Seq ID 154 | HM,S | — | — | NT | NT | NT | NT | — |
| APG00536.1 | Seq ID 26 | M,SS | — | SS | NT | NT | NT | NT | — |
| APG00536.2 | Seq ID 25 | HM,S | — | SS | NT | NT | NT | NT | — |
| APG00638.0 | Seq ID 65 | SS | SS | SS | NT | NT | NT | NT | — |
| APG00781.0 | Seq ID 146 | — | SS | SS | NT | NT | NT | NT | — |
| APG00528.0 | Seq ID 20 | SS | SS | — | NT | NT | NT | NT | — |
| APG00609.0 | Seq ID 57 | SS | SS | SS | NT | NT | NT | NT | — |
| APG00587.1 | Seq ID 48 | HM,S | SS | — | NT | NT | NT | NT | — |
| APG00637.2 | Seq ID 63 | M,S | SS | — | NT | NT | NT | NT | — |
| APG00735.1 | Seq ID 145 | M,SS | — | SS | NT | NT | NT | NT | — |
| APG00326.1 | Seq ID 2 | M,SS | — | — | NT | NT | NT | NT | — |
| APG00326.2 | Seq ID 3 | M,SS | — | SS | NT | NT | NT | NT | — |
| APG00383.1 | Seq ID 7 | SS | — | — | NT | NT | NT | NT | — |
| APG00687.1 | Seq ID 102 | SS | SS | — | NT | NT | NT | NT | — |
| APG00657.1 | Seq ID 80 | SS | SS | — | NT | NT | NT | NT | — |
| APG00710.2 | Seq ID 131 | SS | — | — | NT | NT | NT | NT | — |
| APG00688.1 | Seq ID 105 | SS | — | — | NT | NT | NT | NT | — |
| APG00805.2 | Seq ID 165 | SS | — | S | NT | NT | NT | NT | — |
| APG00493.1 | Seq ID 9 | HM,S | HM,S | HM,S | NT | NT | +/− | NT | — |
| APG00659.1 | Seq ID 82 | HM,S | M,S | HM,S | NT | NT | — | NT | — |
| APG00494.1 | Seq ID 11 | S | — | SS | NT | NT | NT | NT | — |
| APG01000.1 | Seq ID 197 | S | — | SS | NT | NT | NT | NT | — |
| APG00939.1 | Seq ID 50 | S | — | SS | NT | NT | NT | NT | — |
| APG00661.0 | Seq ID 83 | S | — | — | NT | NT | NT | NT | — |
| APG00513.0 | Seq ID 14 | S | SS | SS | NT | NT | NT | NT | — |
| APG00980.1 | Seq ID 187 | SS | SS | — | NT | NT | NT | NT | — |
| APG00707.1 | Seq ID 128 | SS | — | SS | NT | NT | NT | NT | — |
| APG00495.1 | Seq ID 13 | S | SS | SS | NT | NT | NT | NT | — |
| APG00693.2 | Seq ID 107 | SS | — | — | NT | NT | NT | NT | — |
| APG00679.0 | Seq ID 99 | SS | SS | SS | NT | NT | NT | NT | — |
| APG00679.1 | Seq ID 100 | S | S | — | NT | NT | NT | NT | — |
| APG00514.1 | Seq ID 16 | — | — | SS | NT | NT | NT | NT | — |
| APG00729.1 | Seq ID 143 | HM,S | — | SS | NT | NT | NT | NT | — |
| APG00706.0 | Seq ID 126 | M,SS | — | SS | NT | NT | NT | NT | — |
| APG00622.0 | Seq ID 58 | M,SS | — | M,S | NT | NT | — | NT | — |
| APG00663.0 | Seq ID 87 | SS | — | M,SS | NT | NT | — | NT | — |
| APG00543.0 | Seq ID 31 | M,SS | — | — | NT | NT | NT | NT | — |
| APG00543.1 | Seq ID 32 | M,SS | SS | SS | NT | NT | NT | NT | — |
| APG00705.1 | Seq ID 121 | M,SS | — | M,SS | NT | NT | NT | NT | — |
| APG00705.2 | Seq ID 123 | M,SS | — | M,SS | NT | NT | NT | NT | — |
| APG00705.3 | Seq ID 124 | SS | — | NT | NT | NT | NT | — | |
| APG00705.4 | Seq ID 122 | M,SS | — | M,SS | NT | NT | NT | NT | — |
| APG00703.2 | Seq ID 119 | M,S | SS | — | NT | NT | NT | NT | — |
| APG01028.1 | Seq ID 201 | — | SS | — | NT | NT | NT | NT | — |
| APG01028.2 | Seq ID 202 | M,SS | SS | — | NT | NT | NT | NT | — |
| APG00695.1 | Seq ID 111 | M,S | SS | — | NT | NT | NT | NT | — |
| APG00695.2 | Seq ID 110 | M,SS | — | — | NT | NT | NT | NT | — |
| APG00555.1 | Seq ID 34 | SS | — | — | NT | NT | NT | NT | — |
| APG00664.1 | Seq ID 90 | M,S | — | — | NT | NT | NT | NT | — |
| APG00677.0 | Seq ID 98 | SS | — | — | NT | NT | NT | NT | — |
| APG01037.1 | Seq ID 209 | M,S | M,S | M,S | M,S | M, S | NT | NT | 80-100 |
| APG00623.0 | Seq ID 207 | M,SS | M,SS | M, S | M, S | HM,S | NT | NT | 80-100 |
| APG00556.1 | Seq ID 206 | M,SS | M,S | M,SS | S | M, S | NT | NT | 80-100 |
| APG00624.1 | Seq ID 61 | SS | — | SS | NT | NT | NT | NT | — |
| APG00675.0 | Seq ID 97 | SS | SS | — | NT | NT | NT | NT | — |
| APG00649.1 | Seq ID 76 | — | — | SS | NT | NT | NT | NT | — |
| APG00988.0 | Seq ID 194 | — | SS | — | NT | NT | NT | NT | — |
| APG00724.0 | Seq ID 137 | — | — | SS | NT | NT | NT | NT | — |
| APG00724.1 | Seq ID 138 | M,S | SS | SS | NT | NT | NT | NT | — |
| APG00701.1 | Seq ID 114 | — | — | SS | NT | NT | NT | NT | — |
| APG00806.1 | Seq ID 168 | M,SS | — | — | NT | NT | NT | NT | — |
| APG00557.0 | Seq ID 36 | M,S | — | — | NT | NT | NT | NT | — |
| APG00557.1 | Seq ID 37 | SS | — | — | NT | NT | NT | NT | — |
| APG00722.0 | Seq ID 136 | HM,S | — | — | NT | NT | NT | NT | — |
| APG00648.0 | Seq ID 73 | SS | — | — | NT | NT | NT | NT | — |
| APG00648.1 | Seq ID 74 | — | — | SS | NT | NT | NT | NT | — |
| APG00674.0 | Seq ID 96 | — | SS | SS | NT | NT | NT | NT | — |
| APG00718.0 | Seq ID 132 | M,S | — | SS | NT | NT | NT | NT | — |
| APG00641.1 | Seq ID 67 | SS | — | — | NT | NT | NT | NT | — |

TABLE 10-continued

Pesticidal activity of the SEQ ID NOS against various Lepidoptera and Coleopterans.

| APG | Seq ID | FAW | CEW | BCW | ECB | SWCB | CPB | Px | WCR Mortality (%) |
|---|---|---|---|---|---|---|---|---|---|
| APG00912.1 | Seq ID 176 | SS | — | — | NT | NT | NT | NT | — |
| APG00572.0 | Seq ID 46 | S | — | — | NT | NT | NT | NT | — |
| APG00673.1 | Seq ID 95 | — | — | SS | NT | NT | NT | NT | — |
| APG00802.1 | Seq ID 163 | M,S | SS | SS | NT | NT | NT | NT | — |
| APG00810.1 | Seq ID 173 | S | — | — | NT | NT | NT | NT | — |
| APG00644.1 | Seq ID 71 | SS | — | — | NT | NT | NT | NT | — |
| APG00644.2 | Seq ID 72 | M,S | — | SS | NT | NT | NT | NT | — |
| APG01112.0 | Seq ID 204 | HM,S | SS | M,SS | NT | NT | NT | NT | — |
| APG00721.0 | Seq ID 133 | HM,S | SS | M,SS | NT | NT | NT | NT | — |
| APG00721.1 | Seq ID 134 | M,S | SS | SS | NT | NT | NT | NT | — |
| APG00558.1 | Seq ID 39 | HM,S | SS | SS | NT | NT | NT | NT | — |
| APG00558.2 | Seq ID 40 | S | SS | SS | NT | NT | NT | NT | — |

TABLE 11

Scoring scale for Lepidoptera and Coleopteran bioassay

| | |
|---|---|
| — | no effect |
| SS | slight stunt |
| S | Stunt |
| M | Mortality |
| HM | High morality |

Example 21. Pesticidal Activity Against Hemipteran

Protein Expression:

The sequence set forth is SEQ ID NO: 160, 9, 82, 58, 59, 87, 209, 207, and 206 was expressed in E. coli as described in Example 2. 400 mL of LB was inoculated and grown to an OD600 of 0.6. The culture was induced with 0.25 mM IPTG overnight at 16 C. The cells were spun down and the cell pellet is re-suspend in 5 mL of buffer. The resuspension was bead beaten for 2 min on ice.

Second instar SGSB were obtained from a commercial insectary (Benzon Research Inc., Carlisle, Pa.). A 50% v/v ratio of bead beaten lysate sample to 20% sucrose was employed in the bioassay. Stretched parafilm was used as a feeding membrane to expose the SGSB to the diet/sample mixture. The plates were incubated at 25 C:21 C, 16:8 day:night cycle at 65% RH for 5 days.

Mortality is scored for each sample. The controls (MPB empty vector and buffer) showed 0% mortality. The data for SEQ ID NO: 160, 9, 82, 58, 59, 87, 209, 207, and 206 is set forth in Table 12.

TABLE 12

Shows the pesticidal activity of the SEQ ID NOS against Hemipteran

| APG | Seq ID | Tested against SGSB |
|---|---|---|
| APG00801.0 | Seq ID 160 | 50% |
| APG00493.1 | Seq ID 9 | 50% |
| APG00659.1 | Seq ID 82 | 75% |
| APG00622.0 | Seq ID 58 | 75% |
| APG00622.1 | Seq ID 59 | 50% |
| APG00663.0 | Seq ID 87 | 25% |
| APG01037.1 | Seq ID 209 | 100% |
| APG00623.0 | Seq ID 207 | 100% |
| APG00556.1 | Seq ID 206 | 75% |

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (218 sequences)

SEQ ID NO: 1 - protein, 1202 aa, Unknown
  Unknown organism from environmental sample
LLQQKKSVSKLSMGGTNMNPYQNKNEYEILNASQKNLNISNSYPRYPMENSPKQLLQSTNYKDWLNMCQQNQQYGGDFETFIDTAELSAYTIVVGTMLTGFGLTTPIGLVLISFGTLIPVLFPNQDQSNTWSDFITQTKDIIKKEIASTYINNANQILNRSFNVINTYYNHLKTWENNPNPQNTQDVRTQIQLVHYHFQNVIPELVNSCPPNDCDYYNILVLSSYAQVANLHLTVLNQAVKFEAYLKNNRQFDYLEPLPTAIDYYPVLTKAIEDYTNHCVTTYKKGLNLIKTTPDSNLNGNINWNTYNTYRTKMTTSVLDLVALFPNYDVGKYPIGIQSELTREIYQVLNFEESPYKYYDFQYQEDSLTRRPHLFTWLDSLNFYEKAQTTPNNFFTSHYNMFHYTLDNNSQKSSVFGNQNVTDRLKSLDLATNIYIFLLNVTSLDNKYLNDYNNISKMDFFITNGTRLLEKDLTAGSGQINSDVNKNIFGLPILKRRENQGIPTLFPTYDNYSHILSFIKSLSIPATYKTQVYTFAWTHSSVDPKNIIYTHLTTQIPAVKATLLGTATTELSKVVQGPGHTGGDLIDFKDRFKIICQHSNSQQSYFVRIRYASNGSANTRATINLSIPGVAELDMALNPTFSGTDYTNLKYKDFQYLEFLDEVKFGPNQNLSLVFNRSDVYTNTTVLIDKIEFLPITRSIREDREKQKLETVQQIINTFFVNPIKNTLKSEIADYDIDQAAKLVESLSEEIYPQKKIILLDEIKYAKQLSYSRNLLQNGDFNDLIDWKTSNDITIKTGNPIFKASYLDMSETRNTLFPTYIHQKIDESKLKPYTRYQVRGFVRRSKDLELTVTRYGKEIDVIMNVPNDLVFMQSNSSYGDYNSCETLPNPVMDQGNSTLLTDGYATDISSCQPKLGKKHVTCHDRHPFDFHIDTGELDINTNLGIWVLFKISNPDGYATLGNLEVIEEGPLTGEALAHVKQKEKKWKQHMEKKRMETQQAYDPAKQAVDALFTNTQGEELHYHTTLDQIKNADHLVRSIPYVHHAWLPDVPGMNDDLYNNLKVRIEQARYLYDARNVITNGDFAQGLTGWHATGKAAVQQMDGASVLVLSNWSAEVSQNLHVQDHCGYVLRVIAKKEGPGKGYVTMMDCNGNQETLTFTSCEEGYMTKTVEVFPESDRVRIEIGETEGTFYIESIELLCMKG

SEQ ID NO: 2 - protein, 1185 aa, Artificial sequence
  variant of native sequence
MNPYQNKNEYEILNASQKNLNISNSYPRYPMENSPKQLLQSTNYKDWLNMCQQNQQYGGDFETFIDTAELSAYTIVVGTMLTGFGLTTPIGLVLISFGTLIPVLFPNQDQSNTWSDFITQTKDIIKKEIASTYINNANQILNRSFNVINTYYNHLKTWENNPNPQNTQDVRTQIQLVHYHFQNVIPELVNSCPPNDCDYYNILVLSSYAQVANLHLTVLNQAVKFEAYLKNNRQFDYLEPLPTAIDYYPVLTKAIEDYTNHCVTTYKKGLNLIKTTPDSNLNGNINWNTYNTYRTKMTTSVLDLVALFPNYDVGKYPIGIQSELTREIYQVLNFEESPYKYYDFQYQEDSLTRRPHLFTWLDSLNFYEKAQTTPNNFFTSHYNMFHYTLDNNSQKSSVFGNQNVTDRLKSLDLATNIYIFLLNVTSLDNKYLNDYNNISKMDFFITNGTRLLEKDLTAGSGQINSDVNKNIFGLPILKRRENQGIPTLFPTYDNYSHILSFIKSLSIPATYKTQVYTFAWTHSSVDPKNIIYTHLTTQIPAVKATLLGTATTELSKVVQGPGHTGGDLIDFKDRFKIICQHSNSQQSYFVRIRYASNGSANTRATINLSIPGVAELDMALNPTFSGTDYTNLKYKDFQYLEFLDEVKFGPNQNLSLVFNRSDVYTNTTVLIDKIEFLPITRSIREDREKQKLETVQQIINTFFVNPIKNTLKSEIADYDIDQAAKLVESLSEEIYPQKKIILLDEIKYAKQLSYSRNLLQNGDFNDLIDWKTSNDITIKTGNPIFKASYLDMSETRNTLFPTYIHQKIDESKLKPYTRYQVRGFVRRSKDLELTVTRYGKEIDVIMNVPNDLVFMQSNSSYGDYNSCETLPNPVMDQGNSTLLTDGYATDISSCQPKLGKKHVTCHDRHPFDFHIDTGELDINTNLGIWVLFKISNPDGYATLGNLEVIEEGPLTGEALAHVKQKEKKWKQHMEKKRMETQQAYDPAKQAVDALFTNTQGEELHYHTTLDQIKNADHLVRSIPYVHHAWLPDVPGMNDDLYNNLKVRIEQARYLYDARNVITNGDFAQGLTGWHATGKAAVQQMDGASVLVLSNWSAEVSQNLHVQDHCGYVLRVIAKKEGPGKGYVTMMDCNGNQETLTFTSCEEGYMTKTVEVFPESDRVRIEIGETEGTFYIESIELLCMKG

SEQ ID NO: 3 - protein, 679 aa, Artificial sequence
  variant of native sequence
MNPYQNKNEYEILNASQKNLNISNSYPRYPMENSPKQLLQSTNYKDWLNMCQQNQQYGGDFETFIDTAELSAYTIVVGTMLTGFGLTTPIGLVLISFGTLIPVLFPNQDQSNTWSDFITQTKDIIKKEIASTYINNANQILNRSFNVINTYYNHLKTWENNPNPQNTQDVRTQIQLVHYHFQNVIPELVNSCPPNDCDYYNILVLSSYAQVANLHLTVLNQAVKFEAYLKNNRQFDYLEPLPTAIDYYPVLTKAIEDYTNHCVTTYKKGLNLIKTTPDSNLNGNINWNTYNTYRTKMTTSVLDLVALFPNYDVGKYPIGIQSELTREIYQVLNFEESPYKYYDFQYQEDSLTRRPHLFTWLDSLNFYEKAQTTPNNFFTSHYNMFHYTLDNNSQKSSVFGNQNVTDRLKSLDLATNIYIFLLNVTSLDNKYLNDYNNISKMDFFITNGTRLLEKDLTAGSGQINSDVNKNIFGLPILKRRENQGIPTLFPTYDNYSHILSFIKSLSIPATYKTQVYTFAWTHSSVDPKNIIYTHLTTQIPAVKATLLGTATTELSKVVQGPGHTGGDLIDFKDRFKIICQHSNSQQSYFVRIRYASNGSANTRATINLSIPGVAELDMALNPTFSGTDYTNLKYKDFQYLEFLDEVKFGPNQNLSLVFNRSDVYTNTTVLIDKIEFLPI

SEQ ID NO: 4 - protein, 677 aa, Unknown
  Unknown organism from environmental sample
MHAFYLRMEEFSMTTIENNDENKNESIDESSSTSVSNASSRYPLANNQTTVLQNINYKDYLRVTEGGDSKFLGNPETLISSSSVQTGIGIVGEILGALGVPFAGAIAGFYSFIVGLLWPSSTVSIWEMIMEQVEELVNQKITEHAREEALAKLRGLGDGLDVYQRSLENWLENRNNTKARSVVATQFIALELDFVSSIPSFAVGGQEVPLLAIYAQAANLHLLLLRDASIFGEEWGFTSGEISTFYNRQMTRTAQYSDHCVRWYNNGLDKLKDTSAASWLRYHQFRRNMTLLVLDLVALFPSYDTHTYQIKTTAQLTRDVYTDPLAFNKKTSSGFCNPWSTHNGVLFSEVESAVIRPPHLFDILSSVEISTARGKIALNNKAFLDYWIGHSLKYRHANNTSLLHSNYGRITSEKNSFTLEDKDIVEINSTTANLANTYQKAYGVPESRFHMVNRDNSVTSDYLYSKTHTTLEACTHDYESSNEIPLDKNAAVAESYSHRLSHITHHSFSKHSAAYYGSFPVFSWSHVSADINNTVYTDKITQLPLTKSYSIEDNVEIINSCYVGGSLLKVERNMLKSNQVCSIRLSIPKSPKYIVRVRYASTGNGFLGITGISSDTYFNETMSKNSDLKYDSFKYVTLGTINNSTYAYYSLYLPRPGNVGDEQYTIYIDRIEFIPVS

SEQ ID NO: 5 - protein, 665 aa, Artificial sequence
  variant of native sequence
MTTIENNDENKNESIDESSSTSVSNASSRYPLANNQTTVLQNINYKDYLRVTEGGDSKFLGNPETLISSSSVQTGIGIVGEILGALGVPFAGAIAGFYSFIVGLLWPSSTVSIWEMIMEQVEELVNQKITEHAREEALAKLRGLGDGLDVYQRSLENWLENRNNTKARSVVATQFIALELDFVSSIPSFAVGGQEVPLLAIYAQAANLHLLLLRDASIFGEEWGFTSGEISTFYNRQMTRTAQYSDHCVRWYNNGLDKLKDTSAASWLRYHQFRRNMTLLVLDLVALFPSYDTHTYQIKTTAQLTRDVYTDPLAFNKKTSSGFCNPWSTHNGVLFSEVESAVIRPPHLFDILSSVEISTARGKIALNNKAFLDYWIGHSLKYRHANNTSLLHSNYGRITSEKNSFTLEDKDIVEINSTTANLANTYQKAYGVPESRFHMVNRDNSVTSDYLYSKTHTTLEACTHDYESSNEIPLDKNAAVAESYSHRLSHITHHSFSKHSAAYYGSFPVFSWSHVSADINNTVYTDKITQLPLTKSYSIEDNVEIINSCYVGGSLLKVERNMLKSNQVCSIRLSIPKSPKYIVRVRYASTGNGFLGITGISSDTYFNETMSKNSDLKYDSFKYVTLGTINNSTYAYYSLYLPRPGNVGDEQYTIYIDRIEFIPVS

SEQ ID NO: 6 - protein, 846 aa, Unknown
  Unknown organism from environmental sample
MNSLQTLQAQPIIPYNVLANPLSGNADAQPGSLGDLIASLKEAWVEFQKTGSDKLLQTVFQNGFSAASGGSFNYLAVLQAVIGVLGTVLGAEIPGVAVAAPILSMVIGWIWPSKKKDETQQLINLIDAEIQKQLNQALSNQDKNDWTGYLNAIFQISHDAARAVVDAQFTGSEGDTNRQPRTPGVSDYENVYNHLLATTGSLIVALSQMINGNFDTLAIPFFVIGATVQLSTYQTFIQFANKWLPIVYPDYQIQGTAGYTQQQNLINAKSDMRAAIHDHTQKVFNAFKTGMPSLGSDKNSVNAYNRYVRGMVLNGLDMLATWPSMYPDDYPSQTELEQTRVIFSDLVGKDQTVNNAVTLINMVDKSGPDAWNQHSSIDINSISYTRRELQQVQFPIHDGNRGNTTNCYPYAVILNYPDNSYFYGDLYAPQFSGNPTFGGDNDILTVLNARTQHTRYVDSESLQMNYYPYASNDCHILGYCTGGTCLAPSGCSDGYGKSCNETLPNQKINALYPFRMDLGHSGTPDKLGVMSSHVPFNLIPNNVFGAIDSDTNNISGKGFPAEKGYWSNGGDRPIPSSNIAKEWVNGANAVKVEYGAFLAMKANNMTTGKYYIRVRYANPSNKDVNMWQEVWAGNQKLQGGGWTFKSTSDDNVADNFPKQVYVTGQQGNYIIQDITWPTGGKQGDPLNLPSGEIMVKLSGQNSGDSIYVDRIEFIPISETENINYMITSTVPLLPSGQYVPSLSNYPTIWTADSGQQAISATLTFSGLNSTLFLLAKTNPGDDNDENNWDWMCPDGFLGSVLNGTYTFPINNHDSACAKKPFTAIKIGAELIPVSAGTITGSITHQR

SEQ ID NO: 7 - protein, 716 aa, Artificial sequence
  variant of native sequence
MNSLQTLQAQPIIPYNVLANPLSGNADAQPGSLGDLIASLKEAWVEFQKTGSDKLLQTVFQNGFSAASGGSFNYLAVLQAVIGVLGTVLGAEIPGVAVAAPILSMVIGWIWPSKKKDETQQLINLIDAEIQKQLNQALSNQDKNDWTGYLNAIFQISHDAARAVVDAQFTGSEGDTNRQPRTPGVSDYENVYNHLLATTGSLIVALSQMINGNFDTLAIPFFVIGATVQLSTYQTFIQFANKWLPIVYPDYQIQGTAGYTQQQNLINAKSDMRAAIHDHTQKVFNAFKTGMPSLGSDKNSVNAYNRYVRGMVLNGLDMLATWPSMYPDDYPSQTELEQTRVIFSDLVGKDQTVNNAVTLINMVDKSGPDAWNQHSSIDINSISYTRRELQQVQFPIHDGNRGNTTNCYPYAVILNYPDNSYFYGDLYAPQFSGNPTFGGDNDILTVLNARTQHTRYVDSESLQMNYYPYASNDCHILGYCTGGTCLAPSGCSDGYGKSCNETLPNQKINALYPFRMDLGHSGTPDKLGVMSSHVPFNLIPNNVFGAIDSDTNNISGKGFPAEKGYWSNGGDRPIPSSNIAKEWVNGANAVKVEYGAFLAMKANNMTTGKYYIRVRYANPSNKDVNMWQEVWAGNQKLQGGGWTFKSTSDDNVADNFPKQVYVTGQQGNYIIQDITWPTGGKQGDPLNLPSGEIMVKLSGQNSGDSIYVDRIEFIPI

SEQ ID NO: 8 - protein, 295 aa, Unknown
  Unknown organism from environmental sample
VAILDTSQRHLALRTHSSRDVTMTIKEELSLPQSHSIDVDELKQEHEHGSARAVLTSNFSGSFDQFPTKRGGFAIDSYLLDYSAPKQGCWVDGITVYGDIYIGKQNWGTYTRPVFAYLQYMDTISIPQQVTQTRSYQLTKGHTKTFTTSVNAKYSVGGSIGIVNVGSEISVGFSSSESWSTTQTFTESTQLTGPGTFIVYQVVLVYAHNATSAGRQNGNVFAYNKTSTVGSRLDLYYLSAITQNSTVIVESSKAIAPLDWDTVQRNVLMENYNPASNSGHFRFDWSAYDDPHRRY

SEQ ID NO: 9 - protein, 273 aa, Artificial sequence
  variant of native sequence
MTIKEELSLPQSHSIDVDELKQEHEHGSARAVLTSNFSGSFDQFPTKRGGFAIDSYLLDYSAPKQGCWVDGITVYGDIYIGKQNWGTYTRPVFAYLQYMDTISIPQQVTQTRSYQLTKGHTKTFTTSVNAKYSVGGSIGIVNVGSEISVGFSSSESWSTTQTFTESTQLTGPGTFIVYQVVLVYAHNATSAGRQNGNVFAYNKTSTVGSRLDLYYLSAITQNSTVIVESSKAIAPLDWDTVQRNVLMENYNPASNSGHFRFDWSAYDDPHRRY

SEQ ID NO: 10 - protein, 373 aa, Unknown
  Unknown organism from environmental sample
VGKSMTFKVGMKYMFKNKNSRKYLDISKNSTANNANVQQYEYLADAPSERFFLHPLDNNYYAMINVNSGKVLDISENSTANNANIQQYEWLGDAPSEYWFFHREADGYYVIESKLSGKVLDISKNSTANNANVQQYEFLHDAPSERFAAEEAGSVPLPSINTQPLAPVPQYETINDQLPEETERVVTSFTIVPSISVRDPHYGRDTARQIKENPYYMVVKKQWWKKQESYVLAPGETYNFVTTTGIRVTDQETATKTVSWSIGADMGFSFKGFSLGMSSQYSQELQTSISHTTEQLKEETHTHEIKNPFSERMAYSRYILTTEYSVQRKNGTIVNSPWTMTDKTKAHAVTFPKSAGNVLNENKKKISKNESVN

SEQ ID NO: 11 - protein, 369 aa, Artificial sequence
  variant of native sequence
MTFKVGMKYMFKNKNSRKYLDISKNSTANNANVQQYEYLADAPSERFFLHPLDNNYYAMINVNSGKVLDISENSTANNANIQQYEWLGDAPSEYWFFHREADGYYVIESKLSGKVLDISKNSTANNANVQQYEFLHDAPSERFAAEEAGSVPLPSINTQPLAPVPQYETINDQLPEETERVVTSFTIVPSISVRDPHYGRDTARQIKENPYYMVVKKQWWKKQESYVLAPGETYNFVTTTGIRVTDQETATKTVSWSIGADMGFSFKGFSLGMSSQYSQELQTSISHTTEQLKEETHTHEIKNPFSERMAYSRYILTTEYSVQRKNGTIVNSPWTMTDKTKAHAVTFPKSAGNVLNENKKKISKNESVN

SEQ ID NO: 12 - protein, 326 aa, Unknown
  Unknown organism from environmental sample
VKSNILLIDTYNGGYCKMKKRVMLCSLLAGTLLGNVTLSTNVSAAEIEGDKNNIINTPTNTSQQAMKDINQEAIQDIDQKINKMIDSLPLDMFGFKYTRTDRYGESLTYSGINLKENNITNAEPLFFGTNTFYNNGEDTQSYYTASFSEAITTSTTTQVQNGFKSGITTGGKVGIPFVAEGEVKINLEYNFTHTNSNTTSTTRTLTAPSQKVDVPRGKVYKADVYLEKKSTSGNVELYADVLTGVVAGGRTSFIGSVLNKATDQQGLTQSPHDPNQVRAVGKGTFKVEHGTNFIVKTYDVTSGTKAAKLVDTKIIPIKGHHTGTST

SEQ ID NO: 13 - protein, 283 aa, Artificial sequence
  variant of native sequence
MAEIEGDKNNIINTPTNTSQQAMKDINQEAIQDIDQKINKMIDSLPLDMFGFKYTRTDRYGESLTYSGINLKENNITNAEPLFFGTNTFYNNGEDTQSYYTASFSEAITTSTTTQVQNGFKSGITTGGKVGIPFVAEGEVKINLEYNFTHTNSNTTSTTRTLTAPSQKVDVPRGKVYKADVYLEKKSTSGNVELYADVLTGVVAGGRTSFIGSVLNKATDQQGLTQSPHDPNQVRAVGKGTFKVEHGTNFIVKTYDVTSGTKAAKLVDTKIIPIKGHHTGTST

SEQ ID NO: 14 - protein, 347 aa, Unknown
  Unknown organism from environmental sample
MKKYCNPNKVNPNEVNPREVVLYDLDTYLHNLPENITGSPVGLRNRVADGSVSVDQYYVPTPTSDQLINPCNNYGDLPCTYYPFNGSRWAVDSAGLIAEGIDSFQEVNAVALSTPIIADKHEYQNNSSLEQPYVTPSYTEAVTTTTTNTTTHGCKVNPKISYSRKSKLKVRINDVEKGFNLEIGAEYSFNDTNTYTSTTTRTVVFPSFTTYVPPYTTAIVTVTLNRGTYSQSNLPIQTNLYGRYNIYDPEGYAPEIYYFDLYPVIELVNLCCSSSCSQCVTDMVQPIPETEKVRFNGTGGIIADFASNNFVVTTDFIDNATGATVSKKVEYVPATYGPATTAVTTSK

SEQ ID NO: 15 - protein, 677 aa, Unknown
  Unknown organism from environmental sample
MHDYYLRMEEFIMKKTENNLVNKRKSVDKAPSTSVSNVSSRYPLANDQTTVLQNIHYKDYLRLTEGRDSKIFGNPETLISSSSVQTGIDIVGQILGALGVPFAGAIAGFYSFIVGLLWPSSTVSIWEMIMEQVEELVDQKITEHAREQALAKLKGLGDGLEVYQQSLEIWLENRNNTRARSVVAAQFIALELDFVSSIPSFAVGGQEVPLLAIYAQAANLHLLLLRDASIFGEEWGFTSGEISTFYNRQMTRTAQYSDHCVRWYNIGLDKLKDTSAASWLRYHQFRRDMTLLVLDLVALFPSYDTHTYQIKTTAQLTRDVYTDPLAFNKKTSSGFCNPWSTHSGVLFSEVESAVIRPPHLFDILSSVEISTARGKIALNNKAYLDYWIGHSLKYRHANNTSLIQSNYGRITSEKNSFTLEDKDIFEINSTTANLANAYQKAYGVPESRFHMVKRGSSVTSDYLYSKTHTTLEGCTQDYESSDEIPLDKTVAVAESYSHRLSHITYHSFSKNSAAYYGGFPVFAWSHVSADINNTIYVDKITQLPVTKSYSIEDNVKIVNSCYVGGSLLKVERNMLKSNGVCGIRLSIPKSQKYIVRVRYASTGNGFMHMTGVSGDTYFKETMLKNSDLKYDSFKYLTLGTIYDTTYSVYSLYLPRPGNVGDEQYTIYIDRIEFIPVS

SEQ ID NO: 16 - protein, 665 aa, Artificial sequence
  variant of native sequence
MKKTENNLVNKRKSVDKAPSTSVSNVSSRYPLANDQTTVLQNIHYKDYLRLTEGRDSKIFGNPETLISSSSVQTGIDIVGQILGALGVPFAGAIAGFYSFIVGLLWPSSTVSIWEMIMEQVEELVDQKITEHAREQALAKLKGLGDGLEVYQQSLEIWLENRNNTRARSVVAAQFIALELDFVSSIPSFAVGGQEVPLLAIYAQAANLHLLLLRDASIFGEEWGFTSGEISTFYNRQMTRTAQYSDHCVRWYNIGLDKLKDTSAASWLRYHQFRRDMTLLVLDLVALFPSYDTHTYQIKTTAQLTRDVYTDPLAFNKKTSSGFCNPWSTHSGVLFSEVESAVIRPPHLFDILSSVEISTARGKIALNNKAYLDYWIGHSLKYRHANNTSLIQSNYGRITSEKNSFTLEDKDIFEINSTTANLANAYQKAYGVPESRFHMVKRGSSVTSDYLYSKTHTTLEGCTQDYESSDEIPLDKTVAVAESYSHRLSHITYHSFSKNSAAYYGGFPVFAWSHVSADINNTIYVDKITQLPVTKSYSIEDNVKIVNSCYVGGSLLKVERNMLKSNGVCGIRLSIPKSQKYIVRVRYASTGNGFMHMTGVSGDTYFKETMLKNSDLKYDSFKYLTLGTIYDTTYSVYSLYLPRPGNVGDEQYTIYIDRIEFIPVS

SEQ ID NO: 17 - protein, 1282 aa, Unknown
  Unknown organism from environmental sample
LATLNELYPSYYNVLAKPPVSNLSSATDQLSDIAESMKKAWEEFQKTGSFSLEALKQGFSAANGGAFNYLTLLQSGISLAGSFIPGGSFVAPILNMVIGWLWPNKKKDDSQALIDLIDQEVKKELNKALSEQDKNNWVGFLSSIFDNSNTVNNALIDAQWSGTADDPNRQTVSPTVSDYKNVVGKFDAADTSIVTAQSQIMNGNFDVAASSYFVIGATVRIALYQSYIRFCNHWIDQVGFNSDDHKTQLDNLTRAKETMRNTITSYTQRIREVFKDNLPKLDSTKFGINAYNVYVKGMTINVLDMVATWPSLYPNDYDSQTQLEQTRVIFSNMVGQEQGTDGTVKIYNTFDSGSHQHGQINNNNVDLISYFPDELQNLQLAVYTPKGGSGYAYPYGFILNYINSAYKYGDNDPSSGGLSTISAPIQQINATTQHTKYLDGETINGIGASLPGYCDPTYSPKTIPCSEVEKPFSCISAENALKNSCNSVYSSQKINALYPFTQTGVQGNQGKLGVMASHVPYDLNPINIIGEVDSDTKNIILKGIPAEKGTLDNNTRPSVVKEWMNGANAVKLSSNQTLRMKISNETPHNYQIRLRYATENDVGASIWFHLMDPSNRDLTNGNHSFPAPSDKQVSVQGENGNYILNTVIDSIGLPPGQQTILIQNTSSQDLFLDRIEFAPIPTDPTQPFEIPVPETITTPNKINPLWSSNQFFADVISITGTVTNYGSIKIQLLNDKKIVKEFPVEGNGPTMGMGRCRDASYGINNLQNIQIPEKFNQIQILELSDNHYNCFRGDGNNTYTTNITVAIQPSQFMAPEDLEKITAQVNQLFSSSSQTELANTVTDYVIDQVVLKVDALSDDVFGVEKKALRKLVNKAKQLSKDRNVLVGGNFETFNEWFLGRNVIRRSGNDLFKGDHLFLPPAVLYPSYAYQKVDESKLKPYTRYIVSGFVAQSEHLELVVSRYGKEIETVLNVSYGEALPISAGNQSNCCKPGPCQCPSCDGSQPDSHFFSYSIDVGTLYPDLNPGIQFGLRIVKSNGLASVSNMEIREDCQLTEKEIKKVQRKEQKWKKALEKERSEISAILQPVINQINAFYENENWNSDVLPHVTYQDLYNVVLPELPNLRHWFMEDQEGEHYGILQRFKQAVERVFTHLEEKNLMHNGSFANGLTDWLVDGNAQIINLGNGNLALQLSHWDSSVSQTVDISDFDEDKEYKLRVRANGKGTITIQHGEEMETMSLDKNDFYFQEQPFYFEEPSFYLQIQSEANEFIVDSIEIIEVPEEDE

SEQ ID NO: 18 - protein, 680 aa, Artificial sequence
  variant of native sequence
MATLNELYPSYYNVLAKPPVSNLSSATDQLSDIAESMKKAWEEFQKTGSFSLEALKQGFSAANGGAFNYLTLLQSGISLAGSFIPGGSFVAPILNMVIGWLWPNKKKDDSQALIDLIDQEVKKELNKALSEQDKNNWVGFLSSIFDNSNTVNNALIDAQWSGTADDPNRQTVSPTVSDYKNVVGKFDAADTSIVTAQSQIMNGNFDVAASSYFVIGATVRIALYQSYIRFCNHWIDQVGFNSDDHKTQLDNLTRAKETMRNTITSYTQRIREVFKDNLPKLDSTKFGINAYNVYVKGMTINVLDMVATWPSLYPNDYDSQTQLEQTRVIFSNMVGQEQGTDGTVKIYNTFDSGSHQHGQINNNNVDLISYFPDELQNLQLAVYTPKGGSGYAYPYGFILNYINSAYKYGDNDPSSGGLSTISAPIQQINATTQHTKYLDGETINGIGASLPGYCDPTYSPKTIPCSEVEKPFSCISAENALKNSCNSVYSSQKINALYPFTQTGVQGNQGKLGVMASHVPYDLNPINIIGEVDSDTKNIILKGIPAEKGTLDNNTRPSVVKEWMNGANAVKLSSNQTLRMKISNETPHNYQIRLRYATENDVGASIWFHLMDPSNRDLTNGNHSFPAPSDKQVSVQGENGNYILNTVIDSIGLPPGQQTILIQNTSSQDLFLDRIEFAPI

SEQ ID NO: 19 - protein, 1282 aa, Artificial sequence
  variant of native sequence
MATLNELYPSYYNVLAKPPVSNLSSATDQLSDIAESMKKAWEEFQKTGSFSLEALKQGFSAANGGAFNYLTLLQSGISLAGSFIPGGSFVAPILNMVIGWLWPNKKKDDSQALIDLIDQEVKKELNKALSEQDKNNWVGFLSSIFDNSNTVNNALIDAQWSGTADDPNRQTVSPTVSDYKNVVGKFDAADTSIVTAQSQIMNGNFDVAASSYFVIGATVRIALYQSYIRFCNHWIDQVGFNSDDHKTQLDNLTRAKETMRNTITSYTQRIREVFKDNLPKLDSTKFGINAYNVYVKGMTINVLDMVATWPSLYPNDYDSQTQLEQTRVIFSNMVGQEQGTDGTVKIYNTFDSGSHQHGQINNNNVDLISYFPDELQNLQLAVYTPKGGSGYAYPYGFILNYINSAYKYGDNDPSSGGLSTISAPIQQINATTQHTKYLDGETINGIGASLPGYCDPTYSPKTIPCSEVEKPFSCISAENALKNSCNSVYSSQKINALYPFTQTGVQGNQGKLGVMASHVPYDLNPINIIGEVDSDTKNIILKGIPAEKGTLDNNTRPSVVKEWMNGANAVKLSSNQTLRMKISNETPHNYQIRLRYATENDVGASIWFHLMDPSNRDLTNGNHSFPAPSDKQVSVQGENGNYILNTVIDSIGLPPGQQTILIQNTSSQDLFLDRIEFAPIPTDPTQPFEIPVPETITTPNKINPLWSSNQFFADVISITGTVTNYGSIKIQLLNDKKIVKEFPVEGNGPTMGMGRCRDASYGINNLQNIQIPEKFNQIQILELSDNHYNCFRGDGNNTYTTNITVAIQPSQFMAPEDLEKITAQVNQLFSSSSQTELANTVTDYVIDQVVLKVDALSDDVFGVEKKALRKLVNKAKQLSKDRNVLVGGNFETFNEWFLGRNVIRRSGNDLFKGDHLFLPPAVLYPSYAYQKVDESKLKPYTRYIVSGFVAQSEHLELVVSRYGKEIETVLNVSYGEALPISAGNQSNCCKPGPCQCPSCDGSQPDSHFFSYSIDVGTLYPDLNPGIQFGLRIVKSNGLASVSNMEIREDCQLTEKEIKKVQRKEQKWKKALEKERSEISAILQPVINQINAFYENENWNSDVLPHVTYQDLYNVVLPELPNLRHWFMEDQEGEHYGILQRFKQAVERVFTHLEEKNLMHNGSFANGLTDWLVDGNAQIINLGNGNLALQLSHWDSSVSQTVDISDFDEDKEYKLRVRANGKGTITIQHGEEMETMSLDKNDFYFQEQPFYFEEPSFYLQIQSEANEFIVDSIEIIEVPEEDE

SEQ ID NO: 20 - protein, 425 aa, Unknown
  Unknown organism from environmental sample
MVRIYPDFDEMVWEAAQKWAAANGLLFQKSSYADPVDNTDTISLNVKFTDIGCPEECVELEKIRISQAFSNNTEQKQKETFENITYVENHFTWENEYQFVLPGQSFLTIPRLPMSAHEDIHPGFLVNLFGMNQQFHTKLRERRPLRADVFVEPSSSATVQLKVEKQHISQPYQIELSIQGSIIVTAQDRQEQSKEYYVRLTELMPFFCSHKNLSWEGQALVFREKGKFTGILSRAIHAYVTQTCYNGGKTLEYEIPLLGPASERESVSAQQPMPARRLSDEASSTLPSISSNPAAYSQQPITTTSTPCGCASYEPPVSTYTHPSNPTSYSQQPMTTDSTSCGCASYEPPVSTYTHPSNPTSYSQQPMTTTSTPCGCASYEPPVSTYTHPSNPTPHSQQPMTTDSTSCGCSSCMSTKSNGNLYTDQ

SEQ ID NO: 21 - protein, 741 aa, Unknown
  Unknown organism from environmental sample
MLMENNSLNVLANNNMSSFPLFNNKIEPSIAPALIAVEPIAKYLATALAKWVAKEAFAKLKSVIFPGNTPATMEKVRLEVQTLLNQRLQDDRVLILNAEYQGFINLGRVFTDYVSQSTYTPDTAKTHFLSMSNQLIQRLPQFEIAGYEGVSIALFTQMCTLHLGLLKDGILAGSDWGFTPADKDSLICQFNRYVNEYHTRMMGLYSKEFGRLLSINLNQALNFRNMCSLYVFPFSEAWSLLRYEGTKLENTLSLWNFVGLPIANISPYDWGGALYKLLMGAPNQRLNQVQFNYSYFSNAGPTLDGEKIIGTLPRYNGGPTITGWIGNGRLGGFSSPCNNELEITKIKQEITYNGKGGNSNSIAPANAFNEILTATVPTSPEPFFKTADINMTYNVPRGWNIKFDNQVILRTRMPINIPPNSLEYEGYYIRAVSACPQGLPLSYNHDFLTLTYNTLEYVAPTTQNIIVGFSPNITKNFYSRNSHYLSATDDAYVIPALQFATVSDRSFLEDTPDQATDGSIKFNNNFLGNEAKYSIRLNTGFNTATRYRLIIRFKAPARLASGIRVRSQNSGNNRLLAAIPVEGNSGWVNYVTDSFTFNDLGITPTSTNAFFSIDSDGVNASQQWYLSKLILVKDFVNNSGFRNQVPFNPLVITRCPETLFVSNNSSSTYEQGNNYNYDQNSSSAYEQGDNYNYDQNSSSAYEQGDNYNYDQNLCCACNQNYDGSHKQSVGCTCNRNYKNNY

SEQ ID NO: 22 - protein, 857 aa, Unknown
  Unknown organism from environmental sample
MNQNDNNNEFEILDSKGKEGQPRYPFAEAPGVMTSGMEKTYTTGQSANISNATSTTIDVTSQMLRGGKKVAGAIIKMLIKILWPTGTQQEWENFMDAVEQLINEKLDIYARNKATADLVGLQRVLSEYIDRLTIYTDDPNAAHAQSLRTQVITTDNLFEYSMPSFAIRDYEMQLLTVYAQAANLHLAFLEDIVRFGDEWGFTPTEIADFHRSMKERTNEYTNHCVNTYKQGLEKAKTLAANLCNHNTYPWTRYNQGWREEEKPNCTSQLDSGDPQLDERIEQENPYMGDFRWSIGEYQKLEDWNLYNAYRRDMTLMVLDIVSLWPTYDPKLYPTSFGVKSELTRELYTDIRGTTYRSDESQNSLTAIEGRMIPQPSLFRWLFSITISMRQFIGTGGSNDWTSGNIMTAMRIMWRKTLTEQLEELRFGSSGPISINLHPLDHAEGITHVNTRQWFEPRWFEFYSGGYDTELKFQNKCGTIEEKNPFWAAGPYNYIYQPGVRTSQIPEHRLSWITYEPVRENAPFVYPQDKQLGAVALGWTNNSVDQKNAIDIDKITSLPAVKGNEIRGPGSVVRGPGSTGGNLVQLNPTGEVSIKVSQPILNKPGAGYYHVRIRYAAIANGKLNVKRSVNSSTQESVTYDYKQTNALDLTYSSFQYLEVYDFSPVTTASQFEVLLTNESGGPIYIDKIEFIPFQGTTGPEAPGIPADIYYSMSPAIDENYYTIGGSNSVWLALKEIHPTPPRDGQWRFVYDTSKKAYQIGTRLGEYPEEGVLNGVLTSFNPNDLIVFRNESSDQQYWFVKDAGDGYVTLENYRYPGYVVTAPPTTYHGATVTLSPFNGSMNQKFKLTKLSGNDAVILG

SEQ ID NO: 23 - protein, 692 aa, Artificial sequence
  variant of native sequence
MNQNDNNNEFEILDSKGKEGQPRYPFAEAPGVMTSGMEKTYTTGQSANISNATSTTIDVTSQMLRGGKKVAGAIIKMLIKILWPTGTQQEWENFMDAVEQLINEKLDIYARNKATADLVGLQRVLSEYIDRLTIYTDDPNAAHAQSLRTQVITTDNLFEYSMPSFAIRDYEMQLLTVYAQAANLHLAFLEDIVRFGDEWGFTPTEIADFHRSMKERTNEYTNHCVNTYKQGLEKAKTLAANLCNHNTYPWTRYNQGWREEEKPNCTSQLDSGDPQLDERIEQENPYMGDFRWSIGEYQKLEDWNLYNAYRRDMTLMVLDIVSLWPTYDPKLYPTSFGVKSELTRELYTDIRGTTYRSDESQNSLTAIEGRMIPQPSLFRWLFSITISMRQFIGTGGSNDWTSGNIMTAMRIMWRKTLTEQLEELRFGSSGPISINLHPLDHAEGITHVNTRQWFEPRWFEFYSGGYDTELKFQNKCGTIEEKNPFWAAGPYNYIYQPGVRTSQIPEHRLSWITYEPVRENAPFVYPQDKQLGAVALGWTNNSVDQKNAIDIDKITSLPAVKGNEIRGPGSVVRGPGSTGGNLVQLNPTGEVSIKVSQPILNKPGAGYYHVRIRYAAIANGKLNVKRSVNSSTQESVTYDYKQTNALDLTYSSFQYLEVYDFSPVTTASQFEVLLTNESGGPIYIDKIEFIPF

SEQ ID NO: 24 - protein, 835 aa, Unknown
  Unknown organism from environmental sample
VINLSKIRIDVSIIWISCLRVYSFRNLCFYNVCTIAIKNKNYMRDEKMNSNQNKNEYEVLNTSGNNVNTLTKYPFANDPDSSVLSSCQRSGPGNWINILGNAVSQAVSNSQDILSLLRQPSLSGIISMAFSLLNRMTGSNGRSISELSMCDLLAIIDLRVNQSVLDAGVADFNGSLVVYRNYLEALQRWNNNPNSATAEDVRARFRNSDTTFDFILTRGSLTNGGSLARNNAQILLLPSFANAAYFHLLLLRDANVYGDNWGLFRDTPNINYKSKLLDLIKLYTNYCTHWYNQGLNELRNRGNNATAWLEFHRFRRDMTLMVLDIVASFSNFDITRYPRATDIQLSRVIYTDPIGFVNRSDPSAGRTWFSFHNQANFSALESGIPIPSFSQFLDSMRISTGPLSLPASPNIHRAGVWYGNQNNFNGSSSQTFGEVTNENQTISGLNIFRIDSQAVNLNNTTFGVSRSEFYHDTSQGSQRSIYQGFVDTSGTSTAVAQNIQTFFPGENSNIPTPHDYTHILSRSTNLTGGLRQVASGRRSSLVLHGWTHTSLSRQNRVEPNRITQVPAVKVSTDSNCTVIAGPGFTGGDVVRMNSNGSVSYNITPANQQVVIRLRYACQGIASLRMTFGNGSSQVIPLVSTTSSINNLQYENFSFVTGPNSVNFLSAGTSVTIQNISTNSNVVLDRIELVPELPEPPIIPGEYQIVTAINNSSVLDLNSGTRVTLWSNSRGAHQIWSFMYDHQRNAYVIRNVSNPSLVLTWDFTSSNNIVFAAPFSPGRDEQYWIAENFQNGFVLGNLRNPNMVLDVSGGSTSNGTNIIAYPRHNGNAQRFFIRRP

SEQ ID NO: 25 - protein, 644 aa, Artificial sequence
  variant of native sequence
MNSNQNKNEYEVLNTSGNNVNTLTKYPFANDPDSSVLSSCQRSGPGNWINILGNAVSQAVSNSQDILSLLRQPSLSGIISMAFSLLNRMTGSNGRSISELSMCDLLAIIDLRVNQSVLDAGVADFNGSLVVYRNYLEALQRWNNNPNSATAEDVRARFRNSDTTFDFILTRGSLTNGGSLARNNAQILLLPSFANAAYFHLLLLRDANVYGDNWGLFRDTPNINYKSKLLDLIKLYTNYCTHWYNQGLNELRNRGNNATAWLEFHRFRRDMTLMVLDIVASFSNFDITRYPRATDIQLSRVIYTDPIGFVNRSDPSAGRTWFSFHNQANFSALESGIPIPSFSQFLDSMRISTGPLSLPASPNIHRAGVWYGNQNNFNGSSSQTFGEVTNENQTISGLNIFRIDSQAVNLNNTTFGVSRSEFYHDTSQGSQRSIYQGFVDTSGTSTAVAQNIQTFFPGENSNIPTPHDYTHILSRSTNLTGGLRQVASGRRSSLVLHGWTHTSLSRQNRVEPNRITQVPAVKVSTDSNCTVIAGPGFTGGDVVRMNSNGSVSYNITPANQQVVIRLRYACQGIASLRMTFGNGSSQVIPLVSTTSSINNLQYENFSFVTGPNSVNFLSAGTSVTIQNISTNSNVVLDRIELVPE

SEQ ID NO: 26 - protein, 788 aa, Artificial sequence
  variant of native sequence
MNSNQNKNEYEVLNTSGNNVNTLTKYPFANDPDSSVLSSCQRSGPGNWINILGNAVSQAVSNSQDILSLLRQPSLSGIISMAFSLLNRMTGSNGRSISELSMCDLLAIIDLRVNQSVLDAGVADFNGSLVVYRNYLEALQRWNNNPNSATAEDVRARFRNSDTTFDFILTRGSLTNGGSLARNNAQILLLPSFANAAYFHLLLLRDANVYGDNWGLFRDTPNINYKSKLLDLIKLYTNYCTHWYNQGLNELRNRGNNATAWLEFHRFRRDMTLMVLDIVASFSNFDITRYPRATDIQLSRVIYTDPIGFVNRSDPSAGRTWFSFHNQANFSALESGIPIPSFSQFLDSMRISTGPLSLPASPNIHRAGVWYGNQNNFNGSSSQTFGEVTNENQTISGLNIFRIDSQAVNLNNTTFGVSRSEFYHDTSQGSQRSIYQGFVDTSGTSTAVAQNIQTFFPGENSNIPTPHDYTHILSRSTNLTGGLRQVASGRRSSLVLHGWTHTSLSRQNRVEPNRITQVPAVKVSTDSNCTVIAGPGFTGGDVVRMNSNGSVSYNITPANQQVVIRLRYACQGIASLRMTFGNGSSQVIPLVSTTSSINNLQYENFSFVTGPNSVNFLSAGTSVTIQNISTNSNVVLDRIELVPELPEPPIIPGEYQIVTAINNSSVLDLNSGTRVTLWSNSRGAHQIWSFMYDHQRNAYVIRNVSNPSLVLTWDFTSSNNIVFAAPFSPGRDEQYWIAENFQNGFVLGNLRNPNMVLDVSGGSTSNGTNIIAYPRHNGNAQRFFIRRP

SEQ ID NO: 27 - protein, 680 aa, Unknown
  Unknown organism from environmental sample
VKGMNSYQNKNEYEILDASQNNSNMSTHYPRYPLAKDPQASMQNTNYKDWLNLCDTPNMENPEFQSVGRSALSILINLSSRILSLLGIPFAAQIGQLWSYTLNLLWPVANNATQWEIFMRTIEELINIHIETSVRNRALAELAGLGNILEDYKVALQRWDLNPTNPVLQSEVVRQFEIVHAFFRAQMPVFAISGFEVPLLPVYASAANLHLLLLRDVVINGSRWGLSAARINDYHDLQLHLTSTYTDHCVTWYNTGLNRLIGTNARQWVVYNQFRREMTISVLDIISLFSNYDARRYPTKIQSELTRMIYTDPIGTEGNQFIPGWVDNAPSFSVIENSVVRSPEAFTWLERVGIFTGVLHGWSSRSEFWAAHRLFSRRTLGWLFESAVFGNPQNNIGYQEVDFTNFDVFSINSRATSHMFPSGGGRLFGVPRVTFDLSNITNNSLAQRTYNRPFTFGGQDIVSRLSGETTEIPNSSNYSHRLAHISSFPVGNNGSVLSYGWTHRSVNRHNRLNPNSITQIPYIKGHGGLWGPRRGPGHTGGDIVFIGWSNGASIPIQSNSAQRYRIRVRYASSMSIPLTVGIRDESTQSTHVVELNLVGRGPLPNQLRYADFLYTDLTENTTLFETPNRETFYTVFTSVRDGDVRLDRIEFIPENTITIEYEEERNLEKEKKAVDDLFTN

SEQ ID NO: 28 - protein, 677 aa, Artificial sequence
  variant of native sequence
MNSYQNKNEYEILDASQNNSNMSTHYPRYPLAKDPQASMQNTNYKDWLNLCDTPNMENPEFQSVGRSALSILINLSSRILSLLGIPFAAQIGQLWSYTLNLLWPVANNATQWEIFMRTIEELINIHIETSVRNRALAELAGLGNILEDYKVALQRWDLNPTNPVLQSEVVRQFEIVHAFFRAQMPVFAISGFEVPLLPVYASAANLHLLLLRDVVINGSRWGLSAARINDYHDLQLHLTSTYTDHCVTWYNTGLNRLIGTNARQWVVYNQFRREMTISVLDIISLFSNYDARRYPTKIQSELTRMIYTDPIGTEGNQFIPGWVDNAPSFSVIENSVVRSPEAFTWLERVGIFTGVLHGWSSRSEFWAAHRLFSRRTLGWLFESAVFGNPQNNIGYQEVDFTNFDVFSINSRATSHMFPSGGGRLFGVPRVTFDLSNITNNSLAQRTYNRPFTFGGQDIVSRLSGETTEIPNSSNYSHRLAHISSFPVGNNGSVLSYGWTHRSVNRHNRLNPNSITQIPYIKGHGGLWGPRRGPGHTGGDIVFIGWSNGASIPIQSNSAQRYRIRVRYASSMSIPLTVGIRDESTQSTHVVELNLVGRGPLPNQLRYADFLYTDLTENTTLFETPNRETFYTVFTSVRDGDVRLDRIEFIPENTITIEYEEERNLEKEKKAVDDLFTN

SEQ ID NO: 29 - protein, 651 aa, Artificial sequence
  variant of native sequence
MNSYQNKNEYEILDASQNNSNMSTHYPRYPLAKDPQASMQNTNYKDWLNLCDTPNMENPEFQSVGRSALSILINLSSRILSLLGIPFAAQIGQLWSYTLNLLWPVANNATQWEIFMRTIEELINIHIETSVRNRALAELAGLGNILEDYKVALQRWDLNPTNPVLQSEVVRQFEIVHAFFRAQMPVFAISGFEVPLLPVYASAANLHLLLLRDVVINGSRWGLSAARINDYHDLQLHLTSTYTDHCVTWYNTGLNRLIGTNARQWVVYNQFRREMTISVLDIISLFSNYDARRYPTKIQSELTRMIYTDPIGTEGNQFIPGWVDNAPSFSVIENSVVRSPEAFTWLERVGIFTGVLHGWSSRSEFWAAHRLFSRRTLGWLFESAVFGNPQNNIGYQEVDFTNFDVFSINSRATSHMFPSGGGRLFGVPRVTFDLSNITNNSLAQRTYNRPFTFGGQDIVSRLSGETTEIPNSSNYSHRLAHISSFPVGNNGSVLSYGWTHRSVNRHNRLNPNSITQIPYIKGHGGLWGPRRGPGHTGGDIVFIGWSNGASIPIQSNSAQRYRIRVRYASSMSIPLTVGIRDESTQSTHVVELNLVGRGPLPNQLRYADFLYTDLTENTTLFETPNRETFYTVFTSVRDGDVRLDRIEFIPE

SEQ ID NO: 30 - protein, 556 aa, Unknown
  Unknown organism from environmental sample
VNNMYTNNMKTTLKLETTDYEIDQAAISIECMSDEQDLQEKMMLWDEVKLAKQLSQSRNLLYNVNFEDSSNGWKTSNNITIQLDNPIFKGKYLNMPGARDIYGTIFPTYVYQKIEESKLKSYTRYRVRGFVGSSKDLKLMVTRYGKEIDASMDVPNDLAYMQPNLSCGDYRCDSSSPSMMSQGYPTPYTDGYASDMYACPSNFGKKHVKCHDRHPFDFHIDTGELDINTNLGICILFKISNPDGYATLGNLEVIEEGPLTGEALAHVKQKEKKWNQQMEKKRSETQQAYDPAKQAVDALFTNAQGEELHYHITLDYIQNANQLVQSIPYVHHAWLPDAPGMNYDLYNNLKVRIEQARYLYDARNVITNGDFTQGLQGWHTTGKAAVQQMDGASVLVLSNWSAGVSQNLHAQDHHGYVLRVIAKKEGPGKGYVTMMDCNGNQETLKFTSCEEGYMTKTVEVFPESDRVRIEIGETEGTFYIDSIELLCMKGYNNPHTGNMYEQSYNGIYNQNTSDVYHQDSSSMYNQNYTNNDDQHSACTCNQGHNSGCTCNQGYNR

SEQ ID NO: 31 - protein, 781 aa, Bacillus sp.
MNPYQNKNEYEILDAKRNNCHMSNGYPRYPLANDPQMYLRNTHYTDWLTMCNNTNLAGWIPPGSFEFTWLNATVAALTIISVTTALLIAPPLLVGGVIAAGAAILAGTLPLLWPADSKPEDNTFNEIMNATELLINTKISEFVRQTADTKITSLQSLMFYYNNALDNWKKNPNDSAAINTVSTRFQIVNAFFVEAMPALSMPGYELAQLGAYAQAANLHLLLLRDGILYADKWNLAKEATYKQGDLHYQEFLNYRNQYINHCSTWYNEGQIEANNKGNGLVYQRTMTILVLDLIAMFSTYDPRLYTMPIKTEILTRTIYTDGVNRNQTSSIYNPGLFRRLEQMEFHIYEYQGSQFLSGHQNIFRSMNYTHPLIYGPLQGYRSSNINKITTINLGDYDKIYSIKTESRDRIVQGSITFDKINFYGTFNKSWLFSVYNQNGPIIKHSNIPGVEAPSATLDYRNYTHYLSNCIFQSKQNVVSEPDYNTQSYIFGWNHYTIDPTGNYVTDASWVDNNLPAGRYVPQISQVPAVKASDIYNPGRVVNATVEDGPHFTGGDVIVSKAQLDGSGLARTLITFPIIPKRYQASGFRVRMYYAANHTGQLSYRAKDISVTGYASFTKTFDGWEYFRARHEHFKYIEFDTTFNLRNSGQLEEHELLIYYPNTSRVSGDQLLIIDKIEFIPVGIPLNQTLEGYDDSYNQNPNANYNQNYTDTYDSGYNSSQNTDYNYDQEYNTYNQSYNNYNLGNNNYNQNSDCMCNQGYNGNYNQNSGCRCNQGDNGNYPK

SEQ ID NO: 32 - protein, 681 aa, Artificial sequence
  variant of native sequence
MNPYQNKNEYEILDAKRNNCHMSNGYPRYPLANDPQMYLRNTHYTDWLTMCNNTNLAGWIPPGSFEFTWLNATVAALTIISVTTALLIAPPLLVGGVIAAGAAILAGTLPLLWPADSKPEDNTFNEIMNATELLINTKISEFVRQTADTKITSLQSLMFYYNNALDNWKKNPNDSAAINTVSTRFQIVNAFFVEAMPALSMPGYELAQLGAYAQAANLHLLLLRDGILYADKWNLAKEATYKQGDLHYQEFLNYRNQYINHCSTWYNEGQIEANNKGNGLVYQRTMTILVLDLIAMFSTYDPRLYTMPIKTEILTRTIYTDGVNRNQTSSIYNPGLFRRLEQMEFHIYEYQGSQFLSGHQNIFRSMNYTHPLIYGPLQGYRSSNINKITTINLGDYDKIYSIKTESRDRIVQGSITFDKINFYGTFNKSWLFSVYNQNGPIIKHSNIPGVEAPSATLDYRNYTHYLSNCIFQSKQNVVSEPDYNTQSYIFGWNHYTIDPTGNYVTDASWVDNNLPAGRYVPQISQVPAVKASDIYNPGRVVNATVEDGPHFTGGDVIVSKAQLDGSGLARTLITFPIIPKRYQASGFRVRMYYAANHTGQLSYRAKDISVTGYASFTKTFDGWEYFRARHEHFKYIEFDTTFNLRNSGQLEEHELLIYYPNTSRVSGDQLLIIDKIEFIPV

SEQ ID NO: 33 - protein, 679 aa, Unknown
  Unknown organism from environmental sample
VKKMNSYQNKNDYEILDTSPNNSNMSTLHPRYPLANDPQMPMRNTNYKDWLTMCDSNTQFVGDISTYSSPEAALSARDAVFTGINVAGSILSYFGVPFASFSFGLIGRLLGILWPGPDPFAALIVLVEELIKREIDTLVRRGALDALGGLQEILDVYRTRLNTWRNAKTDENLKRLLEQHDIVENFFTFNMVRFRSPGYEILLLPVYAQAANMHLILLRDFDVFGAEWRVGPDQIRDNYERLKGKIREYKDHCVTVYNQGLNLFNRSTAQDWVSFNRFRTDMTLTVLDIATLFPNYDSRIYPSAVKTELTREIYTDPVGYTERGLPWYNPNNTTFATMENSARRPPSYTTWLNRIFVYTGHLGNFSAVRNVWGGHTLIENGNDGSEIIHNFGNPNSITPIQYLNFQNVSVFSIDSIAHVLVVGSQPYRESQYGVSRVTFHTSNINNVPGSLSYEVPNVNQSQTILSELPGKDEQRPDARTFSHRLSYISNFDARRGGSGGNVSLLTYGWTHISMDRNNRLEPNGITQIDAVKGFGDDLVIPGPTGGNLVRLSDRGDRGYSLRVQAPEISTSYRIRLRYACLANFGDAIFVEHSGSSHIVSFFDCSNAPGRPSNTLEESDFRYIDVPGTFTPSINPEIRFRTNSFDGPNALDKIEFIPLDIYNEHFVEERAKTINDLFIN

SEQ ID NO: 34 - protein, 676 aa, Artificial sequence
  variant of native sequence
MNSYQNKNDYEILDTSPNNSNMSTLHPRYPLANDPQMPMRNTNYKDWLTMCDSNTQFVGDISTYSSPEAALSARDAVFTGINVAGSILSYFGVPFASFSFGLIGRLLGILWPGPDPFAALIVLVEELIKREIDTLVRRGALDALGGLQEILDVYRTRLNTWRNAKTDENLKRLLEQHDIVENFFTFNMVRFRSPGYEILLLPVYAQAANMHLILLRDFDVFGAEWRVGPDQIRDNYERLKGKIREYKDHCVTVYNQGLNLFNRSTAQDWVSFNRFRTDMTLTVLDIATLFPNYDSRIYPSAVKTELTREIYTDPVGYTERGLPWYNPNNTTFATMENSARRPPSYTTWLNRIFVYTGHLGNFSAVRNVWGGHTLIENGNDGSEIIHNFGNPNSITPIQYLNFQNVSVFSIDSIAHVLVVGSQPYRESQYGVSRVTFHTSNINNVPGSLSYEVPNVNQSQTILSELPGKDEQRPDARTFSHRLSYISNFDARRGGSGGNVSLLTYGWTHISMDRNNRLEPNGITQIDAVKGFGDDLVIPGPTGGNLVRLSDRGDRGYSLRVQAPEISTSYRIRLRYACLANFGDAIFVEHSGSSHIVSFFDCSNAPGRPSNTLEESDFRYIDVPGTFTPSINPEIRFRTNSFDGPNALDKIEFIPLDIYNEHFVEERAKTINDLFIN

SEQ ID NO: 35 - protein, 655 aa, Artificial sequence
  variant of native sequence
MNSYQNKNDYEILDTSPNNSNMSTLHPRYPLANDPQMPMRNTNYKDWLTMCDSNTQFVGDISTYSSPEAALSARDAVFTGINVAGSILSYFGVPFASFSFGLIGRLLGILWPGPDPFAALIVLVEELIKREIDTLVRRGALDALGGLQEILDVYRTRLNTWRNAKTDENLKRLLEQHDIVENFFTFNMVRFRSPGYEILLLPVYAQAANMHLILLRDFDVFGAEWRVGPDQIRDNYERLKGKIREYKDHCVTVYNQGLNLFNRSTAQDWVSFNRFRTDMTLTVLDIATLFPNYDSRIYPSAVKTELTREIYTDPVGYTERGLPWYNPNNTTFATMENSARRPPSYTTWLNRIFVYTGHLGNFSAVRNVWGGHTLIENGNDGSEIIHNFGNPNSITPIQYLNFQNVSVFSIDSIAHVLVVGSQPYRESQYGVSRVTFHTSNINNVPGSLSYEVPNVNQSQTILSELPGKDEQRPDARTFSHRLSYISNFDARRGGSGGNVSLLTYGWTHISMDRNNRLEPNGITQIDAVKGFGDDLVIPGPTGGNLVRLSDRGDRGYSLRVQAPEISTSYRIRLRYACLANFGDAIFVEHSGSSHIVSFFDCSNAPGRPSNTLEESDFRYIDVPGTFTPSINPEIRFRTNSFDGPNALDKIEFIPL

SEQ ID NO: 36 - protein, 404 aa, Bacillus sp.
MATYKKDEVMNYTSTENMDVNLKSKNDKKPCDCEPVGYATPNLSEESRKFLVITIPTGSRYAFAQNSNAPGESIGSEKCQQLKFHDHLIYDEFVKNDNRFLFIFYQLDTGDFIIANKKTGEVISHVRDSGSDGIVLRPYITMDEEDEVMQWHKFYRADGEFTLDYVDAKMSLVPCGYHNVEAKQIAAYGGTEGAWPVRYLKEGEQNINIPSLPPTSELGPVPEVTGFNDPLPTNDEAKRAIKGSVLIPSILVNDYLLLADRIKKNPYYVLEHRQYWHLLWSDLFTAGSNQLKTEVTGISSDAQEKMKAAVGMSIGSDLGLNFIETSDPFKQQIISGLNSKLSHTKDLNETTTIRDVENPEDFTVRFARYARAHEFVLKDSDGNVVGAPWVVVDGNEMYLKRYKK

SEQ ID NO: 37 - protein, 395 aa, Artificial sequence
  variant of native sequence
MNYTSTENMDVNLKSKNDKKPCDCEPVGYATPNLSEESRKFLVITIPTGSRYAFAQNSNAPGESIGSEKCQQLKFHDHLIYDEFVKNDNRFLFIFYQLDTGDFIIANKKTGEVISHVRDSGSDGIVLRPYITMDEEDEVMQWHKFYRADGEFTLDYVDAKMSLVPCGYHNVEAKQIAAYGGTEGAWPVRYLKEGEQNINIPSLPPTSELGPVPEVTGFNDPLPTNDEAKRAIKGSVLIPSILVNDYLLLADRIKKNPYYVLEHRQYWHLLWSDLFTAGSNQLKTEVTGISSDAQEKMKAAVGMSIGSDLGLNFIETSDPFKQQIISGLNSKLSHTKDLNETTTIRDVENPEDFTVRFARYARAHEFVLKDSDGNVVGAPWVVVDGNEMYLKRYKK

SEQ ID NO: 38 - protein, 750 aa, Bacillus sp.
LDSYPKKNEHGILDASSNYSNMTNNYPRYPVANNSQTSMQNTNYKDWMNMWDSNTINYRRIDSSPEAYVSAKSAISTGISIFSKLLSYLGLGLVADSINITMSLVNTLWNEQNNIWDNLLRHVEDLMDQKISDLVLSNAIVELTNLKRSLNEYAASLENWKKNPGNPNAIEHIKSQFTNTHNSFVERLAVFAHPGYEVLLLSVYVQAANLHLLLLRDASIYGNQWGLARSNSNYFYGRQLYYTNEYTNHCVNWYHNGLNRLRGTTGAHWLNFNRFRTEMTLTVLDIIALFPTYDYRKYPAFTKVELSRVIYTDPVIYDGFSQLPSNNAGNFNDFEREAIGIPSLTKWLKKIEISTGEIRFATNPHTGDWVTNVWNGNTNTFAFTESSSEVVESHGIMTNNRTSLNMNNFDNFRVDLRSHCFSQGAPFYDVFGIGRSQFFNGRTNIIYDNEIGITDRYNRHRHQTTTISLPGANSEQATANDYSHRLADVRNLTGGLRQNPPQQNMGRSSLIGHGWTHVSMKRENILELDKITQIPAVKSNGWMFSGDLLRGPGHTGGDLVTLGNGDRYTLNIIFPAQAYRIRVRYASNGDGEMGIDVNGVGYTRFSIKCTFSHNNYNNLNSQDFCLVDTSFIYNATYTGSKTIWLYSYSTTRVIIDKIEFIPVGIFANQSFEETEGYNQNYSHYDQNMDTTYQPNYDNGYEQNNYDSYDQSCNNTYESNHDCNCNQEYTNNYNQNSGCTCNQKYNNNYPK

SEQ ID NO: 39 - protein, 750 aa, Artificial sequence
  variant of native sequence
MDSYPKKNEHGILDASSNYSNMTNNYPRYPVANNSQTSMQNTNYKDWMNMWDSNTINYRRIDSSPEAYVSAKSAISTGISIFSKLLSYLGLGLVADSINITMSLVNTLWNEQNNIWDNLLRHVEDLMDQKISDLVLSNAIVELTNLKRSLNEYAASLENWKKNPGNPNAIEHIKSQFTNTHNSFVERLAVFAHPGYEVLLLSVYVQAANLHLLLLRDASIYGNQWGLARSNSNYFYGRQLYYTNEYTNHCVNWYHNGLNRLRGTTGAHWLNFNRFRTEMTLTVLDIIALFPTYDYRKYPAFTKVELSRVIYTDPVIYDGFSQLPSNNAGNFNDFEREAIGIPSLTKWLKKIEISTGEIRFATNPHTGDWVTNVWNGNTNTFAFTESSSEVVESHGIMTNNRTSLNMNNFDNFRVDLRSHCFSQGAPFYDVFGIGRSQFFNGRTNIIYDNEIGITDRYNRHRHQTTTISLPGANSEQATANDYSHRLADVRNLTGGLRQNPPQQNMGRSSLIGHGWTHVSMKRENILELDKITQIPAVKSNGWMFSGDLLRGPGHTGGDLVTLGNGDRYTLNIIFPAQAYRIRVRYASNGDGEMGIDVNGVGYTRFSIKCTFSHNNYNNLNSQDFCLVDTSFIYNATYTGSKTIWLYSYSTTRVIIDKIEFIPVGIFANQSFEETEGYNQNYSHYDQNMDTTYQPNYDNGYEQNNYDSYDQSCNNTYESNHDCNCNQEYTNNYNQNSGCTCNQKYNNNYPK

SEQ ID NO: 40 - protein, 663 aa, Artificial sequence
  variant of native sequence
MDSYPKKNEHGILDASSNYSNMTNNYPRYPVANNSQTSMQNTNYKDWMNMWDSNTINYRRIDSSPEAYVSAKSAISTGISIFSKLLSYLGLGLVADSINITMSLVNTLWNEQNNIWDNLLRHVEDLMDQKISDLVLSNAIVELTNLKRSLNEYAASLENWKKNPGNPNAIEHIKSQFTNTHNSFVERLAVFAHPGYEVLLLSVYVQAANLHLLLLRDASIYGNQWGLARSNSNYFYGRQLYYTNEYTNHCVNWYHNGLNRLRGTTGAHWLNFNRFRTEMTLTVLDIIALFPTYDYRKYPAFTKVELSRVIYTDPVIYDGFSQLPSNNAGNFNDFEREAIGIPSLTKWLKKIEISTGEIRFATNPHTGDWVTNVWNGNTNTFAFTESSSEVVESHGIMTNNRTSLNMNNFDNFRVDLRSHCFSQGAPFYDVFGIGRSQFFNGRTNIIYDNEIGITDRYNRHRHQTTTISLPGANSEQATANDYSHRLADVRNLTGGLRQNPPQQNMGRSSLIGHGWTHVSMKRENILELDKITQIPAVKSNGWMFSGDLLRGPGHTGGDLVTLGNGDRYTLNIIFPAQAYRIRVRYASNGDGEMGIDVNGVGYTRFSIKCTFSHNNYNNLNSQDFCLVDTSFIYNATYTGSKTIWLYSYSTTRVIIDKIEFIPV

SEQ ID NO: 41 - protein, 700 aa, Unknown
  Unknown organism from environmental sample
MFRVLYIRNYEHTGGIKMNPYQNTNEYEILDALPNYSKMVNAYSRYPLANNPQVPLQNTSYKDWLNMCQTINPLCTPIDPDINSVAAAIGVIGSILGLIPGPGEAIGLILGTFSSIIPFLWPENKTIIWEEFTHRGLHLIRPELTPAEIEIIVNPLKGYYNALREQLENFEREFAIWDRNKNAATTGDVLRRFSAIDAAIITLKHQLTVDVRNKPALLSLYAQTANIDLILFQRGAKYGDEWVRYARNQPIPFKTSQEYYDSLKAKIEIYTNDIAETYRNGLNIIKNIPKISWDVFNLYRREMTLSALDLVALFPNYDICRYPISTKTELTRKVYMSSFYLQALEQNESIESLENKLTHPPSLFTWLKRLKLYTISENFSPPLRVSSLSGLQAAYSHTHQQQVLYSHPPQGITVGEAPEKRIDGFVYKLFMSQNISPNDCYPIGGIPQMSFYISDYSGSLRPNIDYYSASASIYFINSYMNGPQNATKSNNISIRETKHILSDIKMNYSRTGGFYPFHTFGYSFAWTHTSVDTNNLIVPNRITQIPAVKAHVLSATAKVIAGPGHTGGDLVALINDGSRTGSMNIECKTGSFTQPSRRYGLRMRYAANNLFTVYISLNNQGVGRFDTERTFSRTNNIIPTDLKYNEFKYNNYDKIIMDLPPNTIININIQQTNALSINQFIIDRIEFYPMDQGVEACKME

SEQ ID NO: 42 - protein, 673 aa, Artificial sequence
  variant of native sequence
MNPYQNTNEYEILDALPNYSKMVNAYSRYPLANNPQVPLQNTSYKDWLNMCQTINPLCTPIDPDINSVAAAIGVIGSILGLIPGPGEAIGLILGTFSSIIPFLWPENKTIIWEEFTHRGLHLIRPELTPAEIEIIVNPLKGYYNALREQLENFEREFAIWDRNKNAATTGDVLRRFSAIDAAIITLKHQLTVDVRNKPALLSLYAQTANIDLILFQRGAKYGDEWVRYARNQPIPFKTSQEYYDSLKAKIEIYTNDIAETYRNGLNIIKNIPKISWDVFNLYRREMTLSALDLVALFPNYDICRYPISTKTELTRKVYMSSFYLQALEQNESIESLENKLTHPPSLFTWLKRLKLYTISENFSPPLRVSSLSGLQAAYSHTHQQQVLYSHPPQGITVGEAPEKRIDGFVYKLFMSQNISPNDCYPIGGIPQMSFYISDYSGSLRPNIDYYSASASIYFINSYMNGPQNATKSNNISIRETKHILSDIKMNYSRTGGFYPFHTFGYSFAWTHTSVDTNNLIVPNRITQIPAVKAHVLSATAKVIAGPGHTGGDLVALINDGSRTGSMNIECKTGSFTQPSRRYGLRMRYAANNLFTVYISLNNQGVGRFDTERTFSRTNNIIPTDLKYNEFKYNNYDKIIMDLPPNTIININIQQTNALSINQFIIDRIEFYPM

SEQ ID NO: 43 - protein, 683 aa, Artificial sequence
  variant of native sequence
MNPYQNTNEYEILDALPNYSKMVNAYSRYPLANNPQVPLQNTSYKDWLNMCQTINPLCTPIDPDINSVAAAIGVIGSILGLIPGPGEAIGLILGTFSSIIPFLWPENKTIIWEEFTHRGLHLIRPELTPAEIEIIVNPLKGYYNALREQLENFEREFAIWDRNKNAATTGDVLRRFSAIDAAIITLKHQLTVDVRNKPALLSLYAQTANIDLILFQRGAKYGDEWVRYARNQPIPFKTSQEYYDSLKAKIEIYTNDIAETYRNGLNIIKNIPKISWDVFNLYRREMTLSALDLVALFPNYDICRYPISTKTELTRKVYMSSFYLQALEQNESIESLENKLTHPPSLFTWLKRLKLYTISENFSPPLRVSSLSGLQAAYSHTHQQQVLYSHPPQGITVGEAPEKRIDGFVYKLFMSQNISPNDCYPIGGIPQMSFYISDYSGSLRPNIDYYSASASIYFINSYMNGPQNATKSNNISIRETKHILSDIKMNYSRTGGFYPFHTFGYSFAWTHTSVDTNNLIVPNRITQIPAVKAHVLSATAKVIAGPGHTGGDLVALINDGSRTGSMNIECKTGSFTQPSRRYGLRMRYAANNLFTVYISLNNQGVGRFDTERTFSRTNNIIPTDLKYNEFKYNNYDKIIMDLPPNTIININIQQTNALSINQFIIDRIEFYPMDQGVEACKME

SEQ ID NO: 44 - protein, 306 aa, Bacillus sp.
VERRLKFMAIFDLDAYLMELAKKYFPSPFNQFISRIDTTSLLKVKNAESYGFEIKNSKPQGTMFMGESVLKNDTNETQTIKSDSFTKTITDSITLSVTNGIKTGIEINVGGKVFGIGVETSMSFEVSTSTTREQTSTEGVAYTVPSQDVVVPAKKIYYVYTALQRSQLEGTIRLRADLFNAFGVYMNMGGKEIPLGSYWIYDFIKENQSLHPLPSGISLNHNDRSVHFEGVAEYLYGTGTKFNVTITDTPSSQGTQEHKPFDAKTGLGTYELRLDGKKLGFDLNDLKEHMDPKDFEKLKEMQSEIV

SEQ ID NO: 45 - protein, 299 aa, Artificial sequence
  variant of native sequence
MAIFDLDAYLMELAKKYFPSPFNQFISRIDTTSLLKVKNAESYGFEIKNSKPQGTMFMGESVLKNDTNETQTIKSDSFTKTITDSITLSVTNGIKTGIEINVGGKVFGIGVETSMSFEVSTSTTREQTSTEGVAYTVPSQDVVVPAKKIYYVYTALQRSQLEGTIRLRADLFNAFGVYMNMGGKEIPLGSYWIYDFIKENQSLHPLPSGISLNHNDRSVHFEGVAEYLYGTGTKFNVTITDTPSSQGTQEHKPFDAKTGLGTYELRLDGKKLGFDLNDLKEHMDPKDFEKLKEMQSEIV

SEQ ID NO: 46 - protein, 977 aa, Bacillus sp.
MQENVSGMICNVRGFSLECIGNKLLIKAVYHKKIDNKELQTVSWQWNDSPIYGYGVKEGRYKYDLTEMRDTGKTYEVTSEWSVIDGESINDELPVTETVDTRDSIQYWGNTESEALNAELYNEKSYRYEMSDTSITDKYNFIFKNYYDDGSLIVYEFEYNISDCTIQFKNVSSDLFPLSSVEAAIKDEHQFDGWAMGTCSNTEDIYVKDLSSYTIGLYFKNVSAYTLDQVTKYRVSIDQKEPVTKIRYNPEPDGRMKLDLLPYHKGLGITEGSLITVWAITVNGYAIKVFEGLTNGGEQSIQSNENGYAYDSSIGYSNPNWVGKINGERTISEVSFAGTHGSIALHGVTPFDEDWVRNQRMTITTQLNSGIRYFDIRARRTQNSFAMHHGSVFQKLMFGDVLDAMALFLRQNPYETILMRLKEEHDPETGSASFETILTRYWNLYNSYFWDPKSSNPKLKDVRGKIIIIQNFSASKSFGISYNSLVIQDYDNVDDAPDAMYDKWNRVKSHLQSANNSNKTQIYLNHLSGNGGYNGAKPWFVSSGYNSRGTDSIKKLIQESNSSKWPDYPRGYYGQVFYGGTNLLTKEFIPRLGLQHVGIIAADFPGKGLIDTVVKLNGRLSTSDIQYVRLNANKEIEVGFTGDVYVRKHYQIKRNGSYIASLENGTAYYSYWQQTSFGHQLTRKGITLFTGDKIQVYLVDGGKETLLATLTVEIKEEELEIIQVPDGPYKIISELNKSSVVDLSKTSSQNVALWTYNNQLEGEWDFKYDSTQKAYRIYNRWNSSLVMARNAYDEGINVFGTPYEGKLEHLWIIRRTGDNDGTVYLQNKKDETKQLMLDVQAGGTSNGTNINIWPLNRLKQQKFKLVARRETLESQIDSSYRPLSGQKNRSSSNFSLGHLADGTRVRVSIEGAGSVNLSFRVMRDKPADTDPTIWSDVKNGSILTVQSGANKKDLYIANPSGYSSNGTFKVKFYTLEN

SEQ ID NO: 47 - protein, 606 aa, Unknown
  Unknown organism from environmental sample
MKYKNRKHAKRKYKQALLATVATMTLGVSTLGSTASALAAEDITETRKVTPQLRSADPIADGIFKIAADGTITLLNANLFDSATAKAIASLGGNLLKQLYLDAYNNDFTGSAKTLVLGATALVPYVGSFVSPIIGLLWPANTSNNIAKQTEALVKMMHQEITNYDLEALAQEVKTLAELTSRFDDLLNGKPLSAKEYAETGTIQETLRTKASAINDQFIRVLNQCQKSSFKSEELPIYTTVATARLLFLNVIELHGQGPKMQMDDATYGEYVKDFKNLPTEFTNYIEATHKKTIDEMQKQMKPILDEAKKDPMSVSGNEQENIKNMEKRLAHWRDEVATSKDPTIKEYAKFRRDKMQGYLNAYRGLVNAKSDYIKKTVDNTAFKLVKESLSAPVEIRVPDGNYRLQSALDTNMSVGLSDDQKNIELRKNNDQLNTDFILTYSSLRKTYEIRSSRLDSNLYMTGSYGHDINNVFTMARQYSDSQHWKVLKARGSEFMYLKNYKTSQVLDIFNANPNNGANIITWPLKPQDQNPNNQQFKLVPLELESKEQKLGPEEQILLWDSHKPYKKGDIVKHQDKTYKCIQDYNGDGNPEWIFAKSLWKPISNQ

SEQ ID NO: 48 - protein, 568 aa, Artificial sequence
  variant of native sequence
MAEDITETRKVTPQLRSADPIADGIFKIAADGTITLLNANLFDSATAKAIASLGGNLLKQLYLDAYNNDFTGSAKTLVLGATALVPYVGSFVSPIIGLLWPANTSNNIAKQTEALVKMMHQEITNYDLEALAQEVKTLAELTSRFDDLLNGKPLSAKEYAETGTIQETLRTKASAINDQFIRVLNQCQKSSFKSEELPIYTTVATARLLFLNVIELHGQGPKMQMDDATYGEYVKDFKNLPTEFTNYIEATHKKTIDEMQKQMKPILDEAKKDPMSVSGNEQENIKNMEKRLAHWRDEVATSKDPTIKEYAKFRRDKMQGYLNAYRGLVNAKSDYIKKTVDNTAFKLVKESLSAPVEIRVPDGNYRLQSALDTNMSVGLSDDQKNIELRKNNDQLNTDFILTYSSLRKTYEIRSSRLDSNLYMTGSYGHDINNVFTMARQYSDSQHWKVLKARGSEFMYLKNYKTSQVLDIFNANPNNGANIITWPLKPQDQNPNNQQFKLVPLELESKEQKLGPEEQILLWDSHKPYKKGDIVKHQDKTYKCIQDYNGDGNPEWIFAKSLWKPISNQ

SEQ ID NO: 49 - protein, 959 aa, Unknown
  Unknown organism from environmental sample
MIMQMVTKVMTPKLGALPDFIDDFNGIFGFMDNITGVMSTIFGVDTGDSSIDDVLNNEELLQEMLDQMNTMQISIRDILEQQGISADIEKQILALTTDLATSINTELGKIEGILNTYLPAISNMLSNIYEQTSVIDQKVDKLLALMTFALKELDYIKDNVVLNSSIVEITPHVQKLVYVNKKFLTLTRGFLQGEDVSIDSMQEIQEWAKSILATEMNSFEFSVDTLHSIIIGDNLYKRSALKTFSDVLLDDADQYGDFGTPLAKFYTFFSSLATLQINAYLCLTFARKVLGLSEIDYQVTMQDRIEQQNQMFVNLIQDKNYSNALEITGIYPMSLDRGDCKSTDLQADAGCALIGLEFFMDNGIYKAKAYQGEIGKNFSVSADTVTELISDDLSTLFHDTTNDNPELDVVYPLSGELTGPPNTIITRIGLGTKYDKTRESSVQAFAYIDADFSPYDYISGTISKGGTQTVSLEGNDHKNRGYSNWPIGLIGDLYMTPLKSLSLNVEDTGTTLNMSGESYFSTILSREYNTNFILFPYTNNSSPIAENLIQNGNFEDGDKYWEIVTGAAVIAEGEGIYGSNAISISMDDSGPALKQELKLKPYTSYELTAYIKSKTNKLQQGHISITYNNNDITWITETFSTSYKQIKLNFRTGADNQDFHVTFEEQNSDYLLLDNIQLHEIPQTDNLIDRGDFGVYEGDTNDYRLWQTPYLWELDGGAELTDKETLFKPKCLKIIQRGGANQKVQLKANTNYILTAYVKVDDPTTTAQIGCGSNQIPCNSTSYTPLKLKFRTGEDPSTTESSVYCSNSNDSGTVWADNFVLYEVPNLIVNGDFEQFDQSYWTFSPSEGGRIYLQSGLGMSHSNAVVLQGQNGQISQKVPLKPFTKYRLTAYVKVSRGSIAHIGYGDNTCACAVDDFRQALVDFTTGANPMQSDDAIYLSSGNSKYTVADNFELYELDQI

SEQ ID NO: 50 - protein, 957 aa, Artificial sequence
  variant of native sequence
MQMVTKVMTPKLGALPDFIDDFNGIFGFMDNITGVMSTIFGVDTGDSSIDDVLNNEELLQEMLDQMNTMQISIRDILEQQGISADIEKQILALTTDLATSINTELGKIEGILNTYLPAISNMLSNIYEQTSVIDQKVDKLLALMTFALKELDYIKDNVVLNSSIVEITPHVQKLVYVNKKFLTLTRGFLQGEDVSIDSMQEIQEWAKSILATEMNSFEFSVDTLHSIIIGDNLYKRSALKTFSDVLLDDADQYGDFGTPLAKFYTFFSSLATLQINAYLCLTFARKVLGLSEIDYQVTMQDRIEQQNQMFVNLIQDKNYSNALEITGIYPMSLDRGDCKSTDLQADAGCALIGLEFFMDNGIYKAKAYQGEIGKNFSVSADTVTELISDDLSTLFHDTTNDNPELDVVYPLSGELTGPPNTIITRIGLGTKYDKTRESSVQAFAYIDADFSPYDYISGTISKGGTQTVSLEGNDHKNRGYSNWPIGLIGDLYMTPLKSLSLNVEDTGTTLNMSGESYFSTILSREYNTNFILFPYTNNSSPIAENLIQNGNFEDGDKYWEIVTGAAVIAEGEGIYGSNAISISMDDSGPALKQELKLKPYTSYELTAYIKSKTNKLQQGHISITYNNNDITWITETFSTSYKQIKLNFRTGADNQDFHVTFEEQNSDYLLLDNIQLHEIPQTDNLIDRGDFGVYEGDTNDYRLWQTPYLWELDGGAELTDKETLFKPKCLKIIQRGGANQKVQLKANTNYILTAYVKVDDPTTTAQIGCGSNQIPCNSTSYTPLKLKFRTGEDPSTTESSVYCSNSNDSGTVWADNFVLYEVPNLIVNGDFEQFDQSYWTFSPSEGGRIYLQSGLGMSHSNAVVLQGQNGQISQKVPLKPFTKYRLTAYVKVSRGSIAHIGYGDNTCACAVDDFRQALVDFTTGANPMQSDDAIYLSSGNSKYTVADNFELYELDQI

SEQ ID NO: 51 - protein, 669 aa, Unknown
  Unknown organism from environmental sample
VKNMNSYQNTNEYEILDASQNNSTMSNRYPRYPLANDPQASMQNTNYKDWLNLCDTPNMENPEFQSVGRSALSILINLSSRILSLLGIPFAAQIGQLWSYTLNLLWPVANNATQWEIFMRTIEELINIRIETSVRNRALAELAGLGNILEDYKVALQRWDLNPTNLVLQSEVVRQFEIVHAFFRAQMPVFAIRDFEVPLLPVYASAANLHLLLLRDVVINGSRWGLEDDRINDYHDLQLRLTSTYTDHCVNWYNTGLNRLIGTNARQWVTYNQFRREMTISVLDIISLFSNYDVRRYPTKIQSELTRMIYTDPVGTEGNQFIPGWLDNAPSFSAIENSVVQMPQFFTFLERVGIFTGFLHGWSSRSEFWSAHRLFSRWTLGGLFESAVFGNTQNNIGYQEVDFTNFDVFSINSRATSHMFPNGSARLFGVPQVTFNLSNINNNSLAQRSYNRPFTFGGQDIVSRLPGETTETPNSSNYSHRLAHISSFPVGNNGSVLSYGWTHRSVNRHNRLDPTSITQIPAVKGWGGVTGSVIPGPTGGNLVSLPMSPWSVSLRVQAPQIQTDYRIRLRFACVWPGTHHMWVSHGGISHPVQILCNNTSGRPSNNLLVSDFGYVVVPGTFSPSINPEIRFSSISGSPVLDKIEFIPLDMYNDLFLGDREKTVSDLFIN

SEQ ID NO: 52 - protein, 645 aa, Artificial sequence
  variant of native sequence
MNSYQNTNEYEILDASQNNSTMSNRYPRYPLANDPQASMQNTNYKDWLNLCDTPNMENPEFQSVGRSALSILINLSSRILSLLGIPFAAQIGQLWSYTLNLLWPVANNATQWEIFMRTIEELINIRIETSVRNRALAELAGLGNILEDYKVALQRWDLNPTNLVLQSEVVRQFEIVHAFFRAQMPVFAIRDFEVPLLPVYASAANLHLLLLRDVVINGSRWGLEDDRINDYHDLQLRLTSTYTDHCVNWYNTGLNRLIGTNARQWVTYNQFRREMTISVLDIISLFSNYDVRRYPTKIQSELTRMIYTDPVGTEGNQFIPGWLDNAPSFSAIENSVVQMPQFFTFLERVGIFTGFLHGWSSRSEFWSAHRLFSRWTLGGLFESAVFGNTQNNIGYQEVDFTNFDVFSINSRATSHMFPNGSARLFGVPQVTFNLSNINNNSLAQRSYNRPFTFGGQDIVSRLPGETTETPNSSNYSHRLAHISSFPVGNNGSVLSYGWTHRSVNRHNRLDPTSITQIPAVKGWGGVTGSVIPGPTGGNLVSLPMSPWSVSLRVQAPQIQTDYRIRLRFACVWPGTHHMWVSHGGISHPVQILCNNTSGRPSNNLLVSDFGYVVVPGTFSPSINPEIRFSSISGSPVLDKIEFIPL

SEQ ID NO: 53 - protein, 666 aa, Artificial sequence
  variant of native sequence
MNSYQNTNEYEILDASQNNSTMSNRYPRYPLANDPQASMQNTNYKDWLNLCDTPNMENPEFQSVGRSALSILINLSSRILSLLGIPFAAQIGQLWSYTLNLLWPVANNATQWEIFMRTIEELINIRIETSVRNRALAELAGLGNILEDYKVALQRWDLNPTNLVLQSEVVRQFEIVHAFFRAQMPVFAIRDFEVPLLPVYASAANLHLLLLRDVVINGSRWGLEDDRINDYHDLQLRLTSTYTDHCVNWYNTGLNRLIGTNARQWVTYNQFRREMTISVLDIISLFSNYDVRRYPTKIQSELTRMIYTDPVGTEGNQFIPGWLDNAPSFSAIENSVVQMPQFFTFLERVGIFTGFLHGWSSRSEFWSAHRLFSRWTLGGLFESAVFGNTQNNIGYQEVDFTNFDVFSINSRATSHMFPNGSARLFGVPQVTFNLSNINNNSLAQRSYNRPFTFGGQDIVSRLPGETTETPNSSNYSHRLAHISSFPVGNNGSVLSYGWTHRSVNRHNRLDPTSITQIPAVKGWGGVTGSVIPGPTGGNLVSLPMSPWSVSLRVQAPQIQTDYRIRLRFACVWPGTHHMWVSHGGISHPVQILCNNTSGRPSNNLLVSDFGYVVVPGTFSPSINPEIRFSSISGSPVLDKIEFIPLDMYNDLFLGDREKTVSDLFIN

SEQ ID NO: 54 - protein, 757 aa, Unknown
  Unknown organism from environmental sample
MLMENNSLNVLANNNMSSFPLFNNKIEPSIAPALIAVEPIAKYLATALAKWVAKEAFAKLKSVIFPGNTPATMEKVRLEVQTLLNQRLQDDRVLILNAEYQGFINLGRVFTDYVSQSTYTPDTAKTHFLSMSNQLIQRLPQFEIAGYEGVSIALFTQMCTLHLGLLKDGILAGSDWGFTPADKDSLICQFNRYVNEYHTRMMGLYSKEFGRLLSINLNQALNFRNMCSLYVFPFSEAWSLLRYEGTKLENTLSLWNFVGLPIANISPYDWGGALYKLLMGAPNQRLNQVQFNYSYFSNAGPTLDGEKIIGTLPRYNGGPTITGWIGNGRLGGFSSPCNNELEITKIKQEITYNGKGGNSNSIAPANAFNEILTATVPTSPEPFFKTADINMTYNVPRGWNIKFDNQVILRTRMPINIPPNSLEYEGYYIRAVSACPQGLPLSYNHDFLTLTYNTLEYVAPTTQNIIVGFSPNITKNFYSRNSHYLSATDDAYVIPALQFATVSDRSFLEDTPDQATDGSIKFNNNFLGNEAKYSIRLNTGFNTATRYRLIIRFKAPARLASGIRVRSQNSGNNRLLAAIPVEGNSGWVNYVTDSFTFNDLGITPTSTNAFFSIDSDGVNASQQWYLSKLILVKDFVNNSGFRNQVPFNPLVITRCPETLFVSNNSSSTYEQGNNYNYDQNSSSAYEQGDNYNYDQNSSSAYEQGDNYNYDQNSSSAYEQGDNYNYDQNLCCACNQNYDGSHKQSVGCTCNRNYKNNY

SEQ ID NO: 55 - protein, 853 aa, Unknown
  Unknown organism from environmental sample
MAQLRELQTQSIIPYNVLVNPPISNINLNNDPCVGTDSASLAKCLADAWSTFQKTGVLNYDAFKQGLTVAAGGKLNYLALVQSAIGLAGVLGAEIPGVAIAAPILSLLIGAFWPFGKPAAQNIITIVDQEVQRLLNQDLGDALIKTLNQHLSDLNEFVTDLSDKMHNALFTNNQAISLVAPSDYENVDQSFTAITAAGTNAMSEFLANVSTCTFKEKTPPPCFTQQVFPLFVMAATLDLSIYQSYIKFGNVWLDKIQWTADQQTQGKPKTMADNLNLAKQKMREKIRDFTNQALTAFNDPSIKPKVGTNKNSINSYNRYVRFMQINGLDLVAMWPTMYPDNYTTQMKMEHTRVVFSDLVGQDQSKDGDVTIYTMLDKPGPDVWKQHPQTSIDSIAYFKDELGQIQLAQHYSRQSNGIQCYPYGIILNYPSNTYVYGQLYNPWGEQNMAVSKAPLIDVNAQTQHNSSTSITYEHLDFTGDGTPGTGGSAGCNPIGYCTGGDCYHPTGCSSDFGYSCNTPLPGQKINAFYPFVQSNTEGTADRIGLMSSNVPLDLSPNNVFGELDTETRNIIGKGFPAEKGTLASGNVPTVVREWVNGANAVKLSDVPLTLKMTNMTSGKYYIRVRYANTSNAEISINQSVSAGNQNIQNGPWGLPSTIAGNVAANFPNQLYITGINGNYVLEDITWGVDGQGKPITIPSGDVTVTLSRTNMSQSGDLFIDRVELVPSSPQNLTYIVTKPLVAFTNQSLDTFPTIWTAGPGESGLKANLQLGNLNSTVSFLVKTKDGADSDRNNWEQMCSGGFTRFGNGNLHFKPGDSYPAGCYKSSFTAIKLLNNPSDGRSLLTQGIITGSVFV

SEQ ID NO: 56 - protein, 726 aa, Artificial sequence
  variant of native sequence
MAQLRELQTQSIIPYNVLVNPPISNINLNNDPCVGTDSASLAKCLADAWSTFQKTGVLNYDAFKQGLTVAAGGKLNYLALVQSAIGLAGVLGAEIPGVAIAAPILSLLIGAFWPFGKPAAQNIITIVDQEVQRLLNQDLGDALIKTLNQHLSDLNEFVTDLSDKMHNALFTNNQAISLVAPSDYENVDQSFTAITAAGTNAMSEFLANVSTCTFKEKTPPPCFTQQVFPLFVMAATLDLSIYQSYIKFGNVWLDKIQWTADQQTQGKPKTMADNLNLAKQKMREKIRDFTNQALTAFNDPSIKPKVGTNKNSINSYNRYVRFMQINGLDLVAMWPTMYPDNYTTQMKMEHTRVVFSDLVGQDQSKDGDVTIYTMLDKPGPDVWKQHPQTSIDSIAYFKDELGQIQLAQHYSRQSNGIQCYPYGIILNYPSNTYVYGQLYNPWGEQNMAVSKAPLIDVNAQTQHNSSTSITYEHLDFTGDGTPGTGGSAGCNPIGYCTGGDCYHPTGCSSDFGYSCNTPLPGQKINAFYPFVQSNTEGTADRIGLMSSNVPLDLSPNNVFGELDTETRNIIGKGFPAEKGTLASGNVPTVVREWVNGANAVKLSDVPLTLKMTNMTSGKYYIRVRYANTSNAEISINQSVSAGNQNIQNGPWGLPSTIAGNVAANFPNQLYITGINGNYVLEDITWGVDGQGKPITIPSGDVTVTLSRTNMSQSGDLFIDRVELVPS

SEQ ID NO: 57 - protein, 348 aa, Unknown
  Unknown organism from environmental sample
MKTCSNQNEVNPRALSLFDLEYYLTRTMYNVSATPISLGWRYQKNADLGSWRFSENAIPTPTSGQIPNPCQSIYAAYPYNCTWGSQDYAYTVDTSGLIAGGVDVYQQINSIPLQTPIIADRHEYRNTSSLQQAYVSPSYSESVTTTTTNTTTNGCKFNTKASYSKKSKYKVAIRDIERGFNLEVGAEYNFSNTQTTTASTIRTVTFPSFTTQVPPRTTAIVSIILNRGYYTNYNVPVEVDLTGRFNQGWTSQPPTYVAARYDLYPFVELVQTCCKSCVDCNPKEIRALPSTGTVRFNGTGTFIADVASNNFVVTTSFIDNDTGATVAEQVEYVPAIYEGPAIQTVTTS

SEQ ID NO: 58 - protein, 1422 aa, Bacillus sp
MATINELYPVPYNVLARPVSQNNDALSDFMDIFNDLKGAYDEFSKTGAKDPLQNHLMLAWNAYQTGKIDYLALTKATISLAGLIPGVGAAVPIVNMVVDMVWPSLFGAPKADPYAELFKQIMKAVEDYVGQQFNNFEISWLQTSLQSLRDALAKFQNSIQVAVCQGRAPESGFLATSDADCPSTPIPCEPCSTHLTAVKTAFGDANTTFTTYLPHFKNPASNQTTDDNGFYGDLIAVTLPMFTTAATLQMVMYKGYIQFMEKWGGLTSGELNDVKAELQELIRDNTKVVRDTFKKYLPTLDTGRKQSINKYNRYVRNMVLNVFDLAVIWPSFDGTYYSSSLQLDQTRLVFSDIAGPWEGNENIGANVIDIFSPVSTWVGYQEGSDLRNFTYPRMDLQNVQFHQQSVASHSVTHCYSDGLKLTYNDNQVITAGQNNTDESNQSNKHGYGALVQSPVTDINVYSQNTMYLDVSSISVNGGWAVAGCSPLSSQGNSNNEALTGQKINVIYPVQSNDKSEKHADTSTKWGYMSTHIPFDLVPENIIGDIDQNTKLPSTQIKGFPFEKYGTEYNNRGIVLVPEWINGNHSVKLSSGQSVGIHITNQRKQKYEVRCRYASNGTNNVYFNVDLSENPFRNTVSFDSTANRQMAVQGENGKYVVKSITTVEIPAGNQGFYVHITNQGSSDLFLDRIEFVPPIPLPLPSPSSGLKFDAPGPYILVSKENFVIWKAPVTKICDDSLQVDLSFKFAGYGELQYLGDNDTILTKQTIAWSSEAPYSFSKAFSANDLKEIRFVALDDAVSISQVVGEILCFEGNCHAVLPEPLVVEHASDTTIWPNAGTNVKGNLIVTAETSDFRWSLLDDYDFIALSTSVPPPTFNNGIYTWNVPIASSRPFKYLNFRNLSYNKTTISGTLSACTSDNRSMSINTSINQNNMFSNPTDLANITTQVNALFASNTQNTLATDVSDYKIEEVVLKVDALSDEVFGKEKKALRKLVNQAKRLSKARNLLVGGNFDNLDAWYRGRNVVNVSDHELFKSDHVLLPPPTLYPSYIFQKLEESKLKANTRYTVSGFIAHAEDLEIIVSRYGQEIKKVVQVPYGEAFPLTSSGPVCCVPRSTRNGTPADPHFFSYSIDVGALDMAVGPGIEFGLRIVERTGMARVSNLEIREDRPLKTNELRKVQRAARDWRQKYDQERAEVTALIQPVLNQINALYENEDWNGAIRSGVSYHDLEAIVLPTLPKLNHWFMSDMLGEQGSILAQFQEALDRAYTQLEGRTILHNGHFTTDAANWTIEGDAHHAILEDGRRVLRLPDWSSSVSQTIEIEDFDPDKEYQLVFHAQGEGTVSLQHGEEGEYVETHPHKFANFTTSQRQGVTFETNKVTVEIASEDGEFLVDHIALVEAPLPTDDQNSEGNTTSSTNSNTSMNNNQ

SEQ ID NO: 59 - protein, 693 aa, Artificial sequence
  variant of native sequence
MATINELYPVPYNVLARPVSQNNDALSDFMDIFNDLKGAYDEFSKTGAKDPLQNHLMLAWNAYQTGKIDYLALTKATISLAGLIPGVGAAVPIVNMVVDMVWPSLFGAPKADPYAELFKQIMKAVEDYVGQQFNNFEISWLQTSLQSLRDALAKFQNSIQVAVCQGRAPESGFLATSDADCPSTPIPCEPCSTHLTAVKTAFGDANTTFTTYLPHFKNPASNQTTDDNGFYGDLIAVTLPMFTTAATLQMVMYKGYIQFMEKWGGLTSGELNDVKAELQELIRDNTKVVRDTFKKYLPTLDTGRKQSINKYNRYVRNMVLNVFDLAVIWPSFDGTYYSSSLQLDQTRLVFSDIAGPWEGNENIGANVIDIFSPVSTWVGYQEGSDLRNFTYPRMDLQNVQFHQQSVASHSVTHCYSDGLKLTYNDNQVITAGQNNTDESNQSNKHGYGALVQSPVTDINVYSQNTMYLDVSSISVNGGWAVAGCSPLSSQGNSNNEALTGQKINVIYPVQSNDKSEKHADTSTKWGYMSTHIPFDLVPENIIGDIDQNTKLPSTQIKGFPFEKYGTEYNNRGIVLVPEWINGNHSVKLSSGQSVGIHITNQRKQKYEVRCRYASNGTNNVYFNVDLSENPFRNTVSFDSTANRQMAVQGENGKYVVKSITTVEIPAGNQGFYVHITNQGSSDLFLDRIEFVPP

SEQ ID NO: 60 - protein, 573 aa, Bacillus sp.
LHYCCTRTIKNKRMLKIILQVPLSIYKKGYIKTAKLFLNYTGNLNYLYKRGINMNQLELIQNPWKSRQSSARVVILQVNNPAQTNNSLDITQIENLNHLQQAIDLSNAFQDALVPTSSEFGNNTLRFDISRGLQIANHLIPKAVTIDDKYSILTQNNNQVGTMVDRVTFELKTLFGISLSHSVSQQLTAAIRETFTNLNIQKNSAWIFWGKTTSAQTNYTYNILFAIQNAETGHFMAAIPIGFEITAHAVREKVLFFTVKDYASYSVKIEGIKVAQPLSNENNIAFTGVYNIVSALNNKSVINMSTISYNNVDYKVNLWEKTNTNNQNWAFIYDKDKKAYQIENLFFPGLVLAWNNYGDSNIVFATSNKKYAEHYWILQEAGNNYFYLVNMKNTNLVLDVSDSDNSNGTNVIVHPKNGGTNQKFSIQENHGIQSGTYQLVTALNNSSVVDLNQSNNNVTLWSNNQGNNQKWNFIYDSTRSAYQIKNVANESLVLTWTYYSSDRDNIAAISNQHRPEQYWIPEYIGAGYYRFKNYMNPQGAMDVKGSGTKNGTNILYYSYHGSNNQKFKLLTTK

SEQ ID NO: 61 - protein, 520 aa, Artificial sequence
  variant of native sequence
MNQLELIQNPWKSRQSSARVVILQVNNPAQTNNSLDITQIENLNHLQQAIDLSNAFQDALVPTSSEFGNNTLRFDISRGLQIANHLIPKAVTIDDKYSILTQNNNQVGTMVDRVTFELKTLFGISLSHSVSQQLTAAIRETFTNLNIQKNSAWIFWGKTTSAQTNYTYNILFAIQNAETGHFMAAIPIGFEITAHAVREKVLFFTVKDYASYSVKIEGIKVAQPLSNENNIAFTGVYNIVSALNNKSVINMSTISYNNVDYKVNLWEKTNTNNQNWAFIYDKDKKAYQIENLFFPGLVLAWNNYGDSNIVFATSNKKYAEHYWILQEAGNNYFYLVNMKNTNLVLDVSDSDNSNGTNVIVHPKNGGTNQKFSIQENHGIQSGTYQLVTALNNSSVVDLNQSNNNVTLWSNNQGNNQKWNFIYDSTRSAYQIKNVANESLVLTWTYYSSDRDNIAAISNQHRPEQYWIPEYIGAGYYRFKNYMNPQGAMDVKGSGTKNGTNILYYSYHGSNNQKFKLLTTK

SEQ ID NO: 62 - protein, 1395 aa, Unknown
  Unknown organism from environmental sample
MGGLLMNQYYNNNEYEILDNGDRGYQPRYPLAQAPGSEFQQMNYKDWMDRYTGEEQAGGLIRAEIDANTALTATFGVAWAVLGVSNPVGSAVAGILNVVTPIIFNQVDPNSPLKVWESMIGYAQALIKKELTETVRNLALDHIDRINDYQIDYKNKAKIWETNPTPGNTSQLLDAFRNLKRSCQDAMPHLDTRGYETILLPLYAQAANIHLIVLRDGLMHGRSWGMTNEEYEDLYSGFFGFTNRIATYTNYCTNTFNQGATMDYVADMEDCTKYPWVRYNQDEFYSGFFGPENSCKQASLTNEYTQSQNGFNPSFAGNARYSNGEYKDVEAWNLRNEFISSMTIQVLDTVALWPTYDPKVYTAAVKTEFTREIYTSIRGTTYRSDPAQNTMSAIEARMIRPPHLFEWPQTMTFFFEDVNVRYTWVGNSWTKGQALIGLKTESTRTLDTNMITALQGLTDEYEYYHIPLDVSTGQKDITNIRTKQWFEPREFIFYRSGGQQVLALGTIEEDIPGYSVYLVNDYIYTPSIRQNTFPPIEVPEGTPPPSHRLSWVKFEPVRDNATTFVDPKQIGATIFGWTHTSVDPNNTIDTTKITQIPAVKASGGTDYQVIKGPGSTGGDLVSLPTYAKIEIPLTSSAGQLYTIRIRYAAAEQKRIRIGKKYRDMQWRYTDYDVPSTPYSGGNLTYNAFRYRELGTSQGVLELSIERIDPFDEPIIIDKIEFIPIQGSVETYEADQDLEKARKAVNALFTSDAKNALQLKVTDYLVDQAAKLVECMSDKIYPQEKMCLLDQVKVAKRLSQLRNLLNHGDFEFPDWSGENGWKTSNHVSVMSGNPIFKGRYLHMPGADNPQLSDQVYPTYAYQKIDESKLKPYTRYMIRGFVGSSKDLEVFITRYDKEVHKNMNVPHDILPTDPCTGTHQLGQEPMITNHTIPQDMSCDPCDAGTVMKVQQTFVKCEDPHAFSFHIDTGELDMNQNLGIWVGFKIGTTDGRATFDNLEVIEANPLTGEALARVKKREHKWKQKWMEKRTKIDKAVQTAQGAIQALFTDSNQNRLKPDITLNHILQAETEVQKIPYVYNAFLQGALPPVPGETSDIFQQLSSAVAIARLLYEQRNVLRNGDFMAGLSNWRGAKNAIVQKIGNASVLVISDWSANLSQDVPVNPGHGYILRVTAKKEGSGEGYVTISDGTEDNTETLKFTVGEVATRLAQSDMRSPMQERYQERNMANAPLEAYGTNGYTNNPMTNYPSDNAGANAYPGNHNRNYQPESFGITPYGDENPMMNYPSNDYEANPYPGSTNMTNYNGGCNCGCGTNAYAGENMMRNNPSNENGSDYGCGCRTHTNNKTDSYPMTAHSSSLSGYVTKTFEIFPETNRICIEIGEISGTFKVESIELIRMDCE

SEQ ID NO: 63 - protein, 719 aa, Artificial sequence
  variant of native sequence
MNQYYNNNEYEILDNGDRGYQPRYPLAQAPGSEFQQMNYKDWMDRYTGEEQAGGLIRAEIDANTALTATFGVAWAVLGVSNPVGSAVAGILNVVTPIIFNQVDPNSPLKVWESMIGYAQALIKKELTETVRNLALDHIDRINDYQIDYKNKAKIWETNPTPGNTSQLLDAFRNLKRSCQDAMPHLDTRGYETILLPLYAQAANIHLIVLRDGLMHGRSWGMTNEEYEDLYSGFFGFTNRIATYTNYCTNTFNQGATMDYVADMEDCTKYPWVRYNQDEFYSGFFGPENSCKQASLTNEYTQSQNGFNPSFAGNARYSNGEYKDVEAWNLRNEFISSMTIQVLDTVALWPTYDPKVYTAAVKTEFTREIYTSIRGTTYRSDPAQNTMSAIEARMIRPPHLFEWPQTMTFFFEDVNVRYTWVGNSWTKGQALIGLKTESTRTLDTNMITALQGLTDEYEYYHIPLDVSTGQKDITNIRTKQWFEPREFIFYRSGGQQVLALGTIEEDIPGYSVYLVNDYIYTPSIRQNTFPPIEVPEGTPPPSHRLSWVKFEPVRDNATTFVDPKQIGATIFGWTHTSVDPNNTIDTTKITQIPAVKASGGTDYQVIKGPGSTGGDLVSLPTYAKIEIPLTSSAGQLYTIRIRYAAAEQKRIRIGKKYRDMQWRYTDYDVPSTPYSGGNLTYNAFRYRELGTSQGVLELSIERIDPFDEPIIIDKIEFIPI

SEQ ID NO: 64 - protein, 1390 aa, Artificial sequence
  variant of native sequence
MNQYYNNNEYEILDNGDRGYQPRYPLAQAPGSEFQQMNYKDWMDRYTGEEQAGGLIRAEIDANTALTATFGVAWAVLGVSNPVGSAVAGILNVVTPIIFNQVDPNSPLKVWESMIGYAQALIKKELTETVRNLALDHIDRINDYQIDYKNKAKIWETNPTPGNTSQLLDAFRNLKRSCQDAMPHLDTRGYETILLPLYAQAANIHLIVLRDGLMHGRSWGMTNEEYEDLYSGFFGFTNRIATYTNYCTNTFNQGATMDYVADMEDCTKYPWVRYNQDEFYSGFFGPENSCKQASLTNEYTQSQNGFNPSFAGNARYSNGEYKDVEAWNLRNEFISSMTIQVLDTVALWPTYDPKVYTAAVKTEFTREIYTSIRGTTYRSDPAQNTMSAIEARMIRPPHLFEWPQTMTFFFEDVNVRYTWVGNSWTKGQALIGLKTESTRTLDTNMITALQGLTDEYEYYHIPLDVSTGQKDITNIRTKQWFEPREFIFYRSGGQQVLALGTIEEDIPGYSVYLVNDYIYTPSIRQNTFPPIEVPEGTPPPSHRLSWVKFEPVRDNATTFVDPKQIGATIFGWTHTSVDPNNTIDTTKITQIPAVKASGGTDYQVIKGPGSTGGDLVSLPTYAKIEIPLTSSAGQLYTIRIRYAAAEQKRIRIGKKYRDMQWRYTDYDVPSTPYSGGNLTYNAFRYRELGTSQGVLELSIERIDPFDEPIIIDKIEFIPIQGSVETYEADQDLEKARKAVNALFTSDAKNALQLKVTDYLVDQAAKLVECMSDKIYPQEKMCLLDQVKVAKRLSQLRNLLNHGDFEFPDWSGENGWKTSNHVSVMSGNPIFKGRYLHMPGADNPQLSDQVYPTYAYQKIDESKLKPYTRYMIRGFVGSSKDLEVFITRYDKEVHKNMNVPHDILPTDPCTGTHQLGQEPMITNHTIPQDMSCDPCDAGTVMKVQQTFVKCEDPHAFSFHIDTGELDMNQNLGIWVGFKIGTTDGRATFDNLEVIEANPLTGEALARVKKREHKWKQKWMEKRTKIDKAVQTAQGAIQALFTDSNQNRLKPDITLNHILQAETEVQKIPYVYNAFLQGALPPVPGETSDIFQQLSSAVAIARLLYEQRNVLRNGDFMAGLSNWRGAKNAIVQKIGNASVLVISDWSANLSQDVPVNPGHGYILRVTAKKEGSGEGYVTISDGTEDNTETLKFTVGEVATRLAQSDMRSPMQERYQERNMANAPLEAYGTNGYTNNPMTNYPSDNAGANAYPGNHNRNYQPESFGITPYGDENPMMNYPSNDYEANPYPGSTNMTNYNGGCNCGCGTNAYAGENMMRNNPSNENGSDYGCGCRTHTNNKTDSYPMTAHSSSLSGYVTKTFEIFPETNRICIEIGEISGTFKVESIELIRMDCE

SEQ ID NO: 65 - protein, 496 aa, unknown
  Unknown organism from environmental sample
MEIYNNQKSCIDSPSIRAAYPNYVDSNGRLTMDRNGFNVNQSVHYTNQDWMNYIPDSRRISELSIPGTHGSMALYGGVLGHILINQTMNLGIQLSSGIRYIDIRCRHYYNTFTIHHDLVFQDAYFDSDVLTPVISFLNQNPRETILMRVKEEYDPIGNTRTFGQTFESYWRGREQYFWNPSNSPDPRNPTLGEVRGKIILLQDFTADRLFGMHWYWLNVKDMWELDGSSQIYAKWESVREHFFSAMRNRNLIFLNHLSANGRISTLGDPRPWFVASGFADRENNSLAYQLSSNPSSNWPDNPRLSPTSGPIFYGGTNVLTTRRIRDGRFTHTGIIAADFPGKGLIDGTIALNFPGTLSGDFQIVTALNNSSVVDLNVGSRNVTLWSNDYTDNKRWNFTYDRSENAYVIRSVSNPDLALAWDTSSPNRNVFAAPPGLIRGNEYYWILEKNGDGYIFKNKRDTNMVLDVTAGGIINGTNLQVSPRTGGNAQTFFNRFI

SEQ ID NO: 66 - protein, 302 aa, Bacillus sp.
MGGIMMSILDMRTIAEQYARYWYEPQAVPGSVTNFQMYEGVLYEDVATPTQTNFKVTPALARTAVQTLKNGTDVPQNQTVKFSETKTLTTKTTTTEGIKNTESTKTSTKFSAGFKVDWFNAGMDFTIEVTSTGEYSYTTSTEQSFSNSSLWEVTQPVTVPPHSTVRAILYIYEATFNVNYDLNTKIRGTKTSPIPSYYKYFSIQYRRKSDNSLRTVWFDAANLYDSQWPARPSSFVGREVGGYYPLYYKGKGVSTVATGLYTEVEFIQSPLSGYAGETKIWKTGPILAPSDKKLTLDCSGQY

SEQ ID NO: 67 - protein, 297 aa, Artificial sequence
  variant of native sequence
MSILDMRTIAEQYARYWYEPQAVPGSVTNFQMYEGVLYEDVATPTQTNFKVTPALARTAVQTLKNGTDVPQNQTVKFSETKTLTTKTTTTEGIKNTESTKTSTKFSAGFKVDWFNAGMDFTIEVTSTGEYSYTTSTEQSFSNSSLWEVTQPVTVPPHSTVRAILYIYEATFNVNYDLNTKIRGTKTSPIPSYYKYFSIQYRRKSDNSLRTVWFDAANLYDSQWPARPSSFVGREVGGYYPLYYKGKGVSTVATGLYTEVEFIQSPLSGYAGETKIWKTGPILAPSDKKLTLDCSGQY

SEQ ID NO: 68 - protein, 649 aa, Bacillus sp.
MNSNNKNKHNVIDTLSNNPLSTNSVEYPLANDQSTPLQNVNYKEYLRMSEGNENYPNHEVLISTPGLVDITANITSVILSALGVPILGTVVKLYSKLFSFLWGATPGQDPWKELMDRVEILIDQKLTEYARNKALAELEGLQNVMNSYVDALESWQNNSRNSQTRLLVQQRLVAADSHFKKTMPSFAIKNYEVSLLPVYAQAANLHLLLLRDSQIFGKEWGMPQNEIDLFYKEQLDCIEKYSDHCVEWYHTGLKQLKDRGATAKNWVDYNRFRREITLSVLDIVALFPHYSTHMYPMPIHAELTREIYTDPVGSYLPYKGNFRDVMSWYEMKRYRQPTFQDLENLIRKPNRFTWLKDLKMYTRKRQNGQYEYYNYWVGHELKKALIDEAYIRETTTSGEITSEEDTFTFEDYNIHRVLCNYIGRYDNSLVGVNQVEFHYLDNNTPRKKEYKKDIRVSNQSQKIIDSEEELHSHRLSYVESFGLYWDHKNEKGGTIPIFGWTHHSVAPQNTIYEDKITSIPATKANGYFTSEVIQGPGYTGGDLIQGSQNMGSIKITPPRNANNKKYRLRVRYAAHFDGVLTMTFTSSSGPGTHKINFNATMKNGDSFKYNSFQYVEKEVPISFVDNGILCKASSGFYLDKLEFIPLNES

SEQ ID NO: 69 - protein, 646 aa, Artificial sequence
  variant of native sequence
MNSNNKNKHNVIDTLSNNPLSTNSVEYPLANDQSTPLQNVNYKEYLRMSEGNENYPNHEVLISTPGLVDITANITSVILSALGVPILGTVVKLYSKLFSFLWGATPGQDPWKELMDRVEILIDQKLTEYARNKALAELEGLQNVMNSYVDALESWQNNSRNSQTRLLVQQRLVAADSHFKKTMPSFAIKNYEVSLLPVYAQAANLHLLLLRDSQIFGKEWGMPQNEIDLFYKEQLDCIEKYSDHCVEWYHTGLKQLKDRGATAKNWVDYNRFRREITLSVLDIVALFPHYSTHMYPMPIHAELTREIYTDPVGSYLPYKGNFRDVMSWYEMKRYRQPTFQDLENLIRKPNRFTWLKDLKMYTRKRQNGQYEYYNYWVGHELKKALIDEAYIRETTTSGEITSEEDTFTFEDYNIHRVLCNYIGRYDNSLVGVNQVEFHYLDNNTPRKKEYKKDIRVSNQSQKIIDSEEELHSHRLSYVESFGLYWDHKNEKGGTIPIFGWTHHSVAPQNTIYEDKITSIPATKANGYFTSEVIQGPGYTGGDLIQGSQNMGSIKITPPRNANNKKYRLRVRYAAHFDGVLTMTFTSSSGPGTHKINFNATMKNGDSFKYNSFQYVEKEVPISFVDNGILCKASSGFYLDKLEFIPL

SEQ ID NO: 70 - protein, 882 aa, Bacillus sp.
MEECKLKYKDRTSAKRRFKKAVLIAATTITLGLSTAGGTTSAFAEETSTQKFEIIPDGSIKILENNPNLQNLVADLSGPLFKEAVLTGNSSIQDLQNLGKHMALASTGLLPFGGSFVYEFISAVWPEAGPSQMDLIMKTVPAMIDEKISQYDLDSIQSDMETLRDDLKVFERSINNAPKNIPSGAQAAPGDIQRSNQELAKDINRLFKSLINTCRKSSQKEAELPFYTVVATSHLQFLRFMELNAQSHPRIKMEPDVLNQLFSEPLKVIAQNYKKHINETSQSAQKKIYSKMNSIIDVSINPLENLEHMYVPRGVPTPNYNDKKIEELKTEYTNLFNNMHAYAYVTENNEAFKVISESITGKEMLHMGSQGNVTINAKDQNGFVKYLTAKSDLSQVHCEGYSAGSEQEFMFEAVNAEENIFALKSKINGHYATFDYSYKKIAGLGSFEATDKNDKRTHVKLISLGDSKYAMRSIYDDNNFIYADFDHGGALTAHSKYIGDWEVFTIKGVGGNSPASSIVMPSLNLYTSEGYRYQYVLPTEETTTPILSSGDLKEIDGKWYYGDSGKVVTGQEIINGEWRYLEDGKIVTGWRRINSTGPRYYFNSDGSRFEKTGWQTIEGKVYYFNSDHSMFESKGLQELGGLYYIDLDYTRFEKTGWQTIEGKVYYLNTDHTVFEKIGTQKVEDKLYYFTEEHARFEKTGAQKVEGKLYYFNADHTLYGSIKNQEIGGKSYYVNADYSLFTGLFKAGDGRLFYYDPETGIMAKDKTITIEGYAYKFDSNGTCINPPDGFTGWVNLPSAPDRNHYKIGYKENGEFVTGLKQIENAWYYFDDNHYEVIGWKVIDGKSYYFDPFYENQMTRGETITIKEKSYTFDSNGVCMNPPS

SEQ ID NO: 71 - protein, 877 aa, Artificial sequence
  variant of native sequence
MKYKDRTSAKRRFKKAVLIAATTITLGLSTAGGTTSAFAEETSTQKFEIIPDGSIKILENNPNLQNLVADLSGPLFKEAVLTGNSSIQDLQNLGKHMALASTGLLPFGGSFVYEFISAVWPEAGPSQMDLIMKTVPAMIDEKISQYDLDSIQSDMETLRDDLKVFERSINNAPKNIPSGAQAAPGDIQRSNQELAKDINRLFKSLINTCRKSSQKEAELPFYTVVATSHLQFLRFMELNAQSHPRIKMEPDVLNQLFSEPLKVIAQNYKKHINETSQSAQKKIYSKMNSIIDVSINPLENLEHMYVPRGVPTPNYNDKKIEELKTEYTNLFNNMHAYAYVTENNEAFKVISESITGKEMLHMGSQGNVTINAKDQNGFVKYLTAKSDLSQVHCEGYSAGSEQEFMFEAVNAEENIFALKSKINGHYATFDYSYKKIAGLGSFEATDKNDKRTHVKLISLGDSKYAMRSIYDDNNFIYADFDHGGALTAHSKYIGDWEVFTIKGVGGNSPASSIVMPSLNLYTSEGYRYQYVLPTEETTTPILSSGDLKEIDGKWYYGDSGKVVTGQEIINGEWRYLEDGKIVTGWRRINSTGPRYYFNSDGSRFEKTGWQTIEGKVYYFNSDHSMFESKGLQELGGLYYIDLDYTRFEKTGWQTIEGKVYYLNTDHTVFEKIGTQKVEDKLYYFTEEHARFEKTGAQKVEGKLYYFNADHTLYGSIKNQEIGGKSYYVNADYSLFTGLFKAGDGRLFYYDPETGIMAKDKTITIEGYAYKFDSNGTCINPPDGFTGWVNLPSAPDRNHYKIGYKENGEFVTGLKQIENAWYYFDDNHYEVIGWKVIDGKSYYFDPFYENQMTRGETITIKEKSYTFDSNGVCMNPPS

SEQ ID NO: 72 - protein, 839 aa, Artificial sequence
  variant of native sequence
MEETSTQKFEIIPDGSIKILENNPNLQNLVADLSGPLFKEAVLTGNSSIQDLQNLGKHMALASTGLLPFGGSFVYEFISAVWPEAGPSQMDLIMKTVPAMIDEKISQYDLDSIQSDMETLRDDLKVFERSINNAPKNIPSGAQAAPGDIQRSNQELAKDINRLFKSLINTCRKSSQKEAELPFYTVVATSHLQFLRFMELNAQSHPRIKMEPDVLNQLFSEPLKVIAQNYKKHINETSQSAQKKIYSKMNSIIDVSINPLENLEHMYVPRGVPTPNYNDKKIEELKTEYTNLFNNMHAYAYVTENNEAFKVISESITGKEMLHMGSQGNVTINAKDQNGFVKYLTAKSDLSQVHCEGYSAGSEQEFMFEAVNAEENIFALKSKINGHYATFDYSYKKIAGLGSFEATDKNDKRTHVKLISLGDSKYAMRSIYDDNNFIYADFDHGGALTAHSKYIGDWEVFTIKGVGGNSPASSIVMPSLNLYTSEGYRYQYVLPTEETTTPILSSGDLKEIDGKWYYGDSGKVVTGQEIINGEWRYLEDGKIVTGWRRINSTGPRYYFNSDGSRFEKTGWQTIEGKVYYFNSDHSMFESKGLQELGGLYYIDLDYTRFEKTGWQTIEGKVYYLNTDHTVFEKIGTQKVEDKLYYFTEEHARFEKTGAQKVEGKLYYFNADHTLYGSIKNQEIGGKSYYVNADYSLFTGLFKAGDGRLFYYDPETGIMAKDKTITIEGYAYKFDSNGTCINPPDGFTGWVNLPSAPDRNHYKIGYKENGEFVTGLKQIENAWYYFDDNHYEVIGWKVIDGKSYYFDPFYENQMTRGETITIKEKSYTFDSNGVCMNPPS

SEQ ID NO: 73 - protein, 399 aa, Bacillus sp.
MKSWKIKKFPFSKKIVTGLFAGTMALSIGVPASHAATPEKNAYYSIHLAAKPSIAWDVFRGWTSDDAGIVLWNGSLGDNEQFVFFPLDGGAYAIVNKNSGKPVGLGGGINFTDGVRNMSVADNNGLGQNNWTGASTDQWYLRDKGNNNYEIVNQGNGRVASWAGAGGTVAGYIDYVDLDESDPSDKNRLFQISAARSTFSLPRLPAIGTRPTAPEYNPAGRVDQQLPQTSESAVVAATLIPCIMVKDNSLSDYTKIHNSPYYVLEKEEYWEKVSSEIVPAGGTSKYTVKRGVSTVDQQKMTDTLAMNFGADLGLKFGNQSLALKYGISKTLQTEVSKTSTDATEEGRDKQYVSAASTDTGLTVYQLVTRYTLKRTDGSAVSSSWSVRDNLQTTERTIKK

SEQ ID NO: 74 - protein, 365 aa, Artificial sequence
  variant of native sequence
MATPEKNAYYSIHLAAKPSIAWDVFRGWTSDDAGIVLWNGSLGDNEQFVFFPLDGGAYAIVNKNSGKPVGLGGGINFTDGVRNMSVADNNGLGQNNWTGASTDQWYLRDKGNNNYEIVNQGNGRVASWAGAGGTVAGYIDYVDLDESDPSDKNRLFQISAARSTFSLPRLPAIGTRPTAPEYNPAGRVDQQLPQTSESAVVAATLIPCIMVKDNSLSDYTKIHNSPYYVLEKEEYWEKVSSEIVPAGGTSKYTVKRGVSTVDQQKMTDTLAMNFGADLGLKFGNQSLALKYGISKTLQTEVSKTSTDATEEGRDKQYVSAASTDTGLTVYQLVTRYTLKRTDGSAVSSSWSVRDNLQTTERTIKK

SEQ ID NO: 75 - protein, 381 aa, Bacillus sp.
VCMANDKSNNENNMNIPKVNNEDSIPSEIMASGARVSFPDFNFYNIRTFCGKYVDIAKGSTADRAGAVQYAGNNSDNQKFLIFTLDDNYSVIAAKHSGKVLDIARIPPFNNDLLIQYYFQNSDNQKFFISNDGVISIKISGQVWDIPNGSTSNDIPITSFRYQGSPNQKFSLVKNGSVSINPPARGTLPPAPDFKTNDINEQLPNETTPVNTHFTYLPYFMVKDPYYNPQQQMKNSPYYILVRRQYWEKKTQRILAPSEFHEYSETIGVSRTNQTSMTNTTEISIGADLGFSFKGFSAGLSTSITKTLSVTESTSQTDSTETTRKVGYTNPFTYLIAYAKYMLINEYYVTRADGQTITAGTTTYWKVPDQDHTVSRTIPRS

SEQ ID NO: 76 - protein, 379 aa, Artificial sequence
  variant of native sequence
MANDKSNNENNMNIPKVNNEDSIPSEIMASGARVSFPDFNFYNIRTFCGKYVDIAKGSTADRAGAVQYAGNNSDNQKFLIFTLDDNYSVIAAKHSGKVLDIARIPPFNNDLLIQYYFQNSDNQKFFISNDGVISIKISGQVWDIPNGSTSNDIPITSFRYQGSPNQKFSLVKNGSVSINPPARGTLPPAPDFKTNDINEQLPNETTPVNTHFTYLPYFMVKDPYYNPQQQMKNSPYYILVRRQYWEKKTQRILAPSEFHEYSETIGVSRTNQTSMTNTTEISIGADLGFSFKGFSAGLSTSITKTLSVTESTSQTDSTETTRKVGYTNPFTYLIAYAKYMLINEYYVTRADGQTITAGTTTYWKVPDQDHTVSRTIPRS

SEQ ID NO: 77 - protein, 1245 aa, Unknown
  Unknown organism from environmental sample
MVNSSEFYPSYYNVLATPVSNFSSTFDQFSDIAEEMKKAWEQFQKTGSFSLEALKQGFSAANGGAFNYLTLLQSGISLAGSFIPGGSFVAPILNMVIGWLWPNKKKDDSQALIDLIDKEIQKELNKALTEQDKNNWTGFLTSIFDNSNTVNNAIIDAQWSGTADDTNRQTVSPTVSDYKNVVGKFDSADTSIVTAQSQIMNGNFDVAASSYFVIGATVRLALYQSYIRFCNHWIDQVGFDSADHKTQLDNLTRAKETMRNTITSYTQRIRKVFKDNLPKLDSTKFGINAYNVYVKGMTINVLDMVATWSSLYPNDYDSQTQLEQTRVIFSNMVGQEQATDGTVKIYNTFDSGSHQHGQITNNNVDLISYFPDELQNLELAVYTPKGGSGYAYPYGFILNYTNSNYKYGDNDPTGGVLSKQNGPIQQMNAATQTSKYVDGETINGIGASLPGYCTTSCSEIASPFSCTSTANSYKASCNSVYTSQKINALYPFTQTGVKGSTGKLGVMASHVPYDLNPINIIGEVDPDTNNMILKGMPAEKGTFENNTRPNVVKEWMNGANAVKLSSNQVLKMNITNVTAHKYQIRLRYATQGDVGASIWFHLIDPSNKDLTNGNHSFPAPSDKQVKVQGENGNYILTTVIDSIDLPTGQQTILIQNTSSQDLFLDRIEFAPVPGPPPNPNQIPAQDFYIPFKGHTPFWNSDNGKIVTQATFEQPVQRNYLRLYLKGNYVGLVPENGIVTTPFDSIVLYNSTEPSSVTAHFAGATLTFATTNEIYFDNPGDLEKITNQVNQLFTSSSQTELSPTVTDYRIDQVILKVDALSNDVFVVEKNALRKLVNKAKQLSKARNVLVGGNFENFDEWSLGRNVIRRSGNDLFKGDHLFLPPAALYPSYAYQKVDESKLKPYTRYTVSGFVAQSEHLELVVSRYSKEIETVLNVPYEESLPITSDDQPNCCKPSPCQCSSCDGSQPDSHFFSYSIDVGALHLALNPGIEFGLRIVKPNGLAFVSNMEIREDRPLTEREIKKLQRKEQKWKKAFEKERAEISALLQPIINRINTFYKNEDWNSDILPHVTYQDVFSVVLPELPNLRHWFMEDREGEHNEILKKLQQAIDRVFTHLEEQNLLHNGSFTNGLTDWLVEGDARIIDLGNGNLALQLSHWDASASQSIDISDFDDEKEYKLRVRGKGKGTITIQHGEEMETMSFDKTGFYFQEQPFYFEEPSFYLQVQSEANEFIVDSIEIIEVPEEDE

SEQ ID NO: 78 - protein, 672 aa, Artificial sequence
  variant of native sequence
MVNSSEFYPSYYNVLATPVSNFSSTFDQFSDIAEEMKKAWEQFQKTGSFSLEALKQGFSAANGGAFNYLTLLQSGISLAGSFIPGGSFVAPILNMVIGWLWPNKKKDDSQALIDLIDKEIQKELNKALTEQDKNNWTGFLTSIFDNSNTVNNAIIDAQWSGTADDTNRQTVSPTVSDYKNVVGKFDSADTSIVTAQSQIMNGNFDVAASSYFVIGATVRLALYQSYIRFCNHWIDQVGFDSADHKTQLDNLTRAKETMRNTITSYTQRIRKVFKDNLPKLDSTKFGINAYNVYVKGMTINVLDMVATWSSLYPNDYDSQTQLEQTRVIFSNMVGQEQATDGTVKIYNTFDSGSHQHGQITNNNVDLISYFPDELQNLELAVYTPKGGSGYAYPYGFILNYTNSNYKYGDNDPTGGVLSKQNGPIQQMNAATQTSKYVDGETINGIGASLPGYCTTSCSEIASPFSCTSTANSYKASCNSVYTSQKINALYPFTQTGVKGSTGKLGVMASHVPYDLNPINIIGEVDPDTNNMILKGMPAEKGTFENNTRPNVVKEWMNGANAVKLSSNQVLKMNITNVTAHKYQIRLRYATQGDVGASIWFHLIDPSNKDLTNGNHSFPAPSDKQVKVQGENGNYILTTVIDSIDLPTGQQTILIQNTSSQDLFLDRIEFAPV

SEQ ID NO: 79 - protein, 947 aa, Unknown
  Unknown organism from environmental sample
MIMQMVTKAMTTKLGALPDFIDDFNGIFGFMDSITGVMSTIFGVDTGDSSIDDVINNQELLQEMQAQMQQMQDSITDMANNQIISENIERQILALTNDLSTSITTEFKKIEGILNTYLPAISKMLGEVYEQTSEINEKVDKLLAMMTFALKELDYIKDNVVLNSSIVEITPHVQKLVYVNKKFLSLTKSFFQNEDLSIDSMQEMLEWAKSILATEMNSFEFSVDTLHSIIIGDNLYKRSALKTFSDVLLDDADQYGDFGTPLAKFYTFFSSLATLQINAYLCLTFARKVLGLSEFDYQVTMEDRIEQQNQLFVNLIQDKNYSNVLEIDGIYPMPMKAGECKGLDLQADDGYALIGLEFFMDNGIYKAKAYQGKLDKNFSVHADTVTEIISDDLSTVFLHNTDTPPVLNIVYPLSGELTGPPNTIITRIGLGTKYDNTRQSGVQAFAYIDADFSPYDYKSGTISKHGKNTVSLEGSDTRNSFYSKWPIGLIGDLYMTPLKSLALNVDVDNGFLNMGGESYFSTILSREYNSNFILFPHANNSSPIVENLIQNGDFENGDTNWKVTGGTAVIAKGEGVYGSNAMQLNMDAITQDVTLKPYTNYELTLYGKIDYSVLLISIYEASKNTFIAEAQFTSTIYKQTKLTLKTGEYTTFTISVSGLEPNDGFIDNIQLCEVPETDNIIDCGGFGGQVDPSLHTNPYLWELNGGGKVVGNEGLFDDKVLKITKSGGANQKIKLERNTNYILSAYVKVDASTTTAQIGCGSHQEICNSTSYTPIEVKFRTGDDPVTTENSIYCSNPNDSGTVWADNFVLYKVPNLVVNGDFENVDLSSWNLSPSESGTISLGIAKGISNSNAIVLRGKGQISQKVALKPYTKYRLTAYVKVSKGSTAYIGYGENECACAVDDFRQAHVEFTTGANPMQTDNVIYLSTGDSQYTVADNFELYEFDQI

SEQ ID NO: 80 - protein, 945 aa, Artificial sequence
  variant of native sequence
MQMVTKAMTTKLGALPDFIDDFNGIFGFMDSITGVMSTIFGVDTGDSSIDDVINNQELLQEMQAQMQQMQDSITDMANNQIISENIERQILALTNDLSTSITTEFKKIEGILNTYLPAISKMLGEVYEQTSEINEKVDKLLAMMTFALKELDYIKDNVVLNSSIVEITPHVQKLVYVNKKFLSLTKSFFQNEDLSIDSMQEMLEWAKSILATEMNSFEFSVDTLHSIIIGDNLYKRSALKTFSDVLLDDADQYGDFGTPLAKFYTFFSSLATLQINAYLCLTFARKVLGLSEFDYQVTMEDRIEQQNQLFVNLIQDKNYSNVLEIDGIYPMPMKAGECKGLDLQADDGYALIGLEFFMDNGIYKAKAYQGKLDKNFSVHADTVTEIISDDLSTVFLHNTDTPPVLNIVYPLSGELTGPPNTIITRIGLGTKYDNTRQSGVQAFAYIDADFSPYDYKSGTISKHGKNTVSLEGSDTRNSFYSKWPIGLIGDLYMTPLKSLALNVDVDNGFLNMGGESYFSTILSREYNSNFILFPHANNSSPIVENLIQNGDFENGDTNWKVTGGTAVIAKGEGVYGSNAMQLNMDAITQDVTLKPYTNYELTLYGKIDYSVLLISIYEASKNTFIAEAQFTSTIYKQTKLTLKTGEYTTFTISVSGLEPNDGFIDNIQLCEVPETDNIIDCGGFGGQVDPSLHTNPYLWELNGGGKVVGNEGLFDDKVLKITKSGGANQKIKLERNTNYILSAYVKVDASTTTAQIGCGSHQEICNSTSYTPIEVKFRTGDDPVTTENSIYCSNPNDSGTVWADNFVLYKVPNLVVNGDFENVDLSSWNLSPSESGTISLGIAKGISNSNAIVLRGKGQISQKVALKPYTKYRLTAYVKVSKGSTAYIGYGENECACAVDDFRQAHVEFTTGANPMQTDNVIYLSTGDSQYTVADNFELYEFDQI

SEQ ID NO: 81 - protein, 296 aa, Unknown
  Unknown organism from environmental sample
LNIHQCLQYSPALSGTLPEPTRETTMTIKEELGQPQSHSIELDSLSGEAGDIRAALTSNLAGSFDQYPTKSGDFQIDSYLLDYSAPKQGCWVNGITVYGDIYIGKQNWGTYTRPVFAYLQYMDTISIPQQVTQTRSYQLTKGHTQSFTTSVSAKYSVGAKIDIVNIGSEISTGFSQTESWSTTQTFTESTQLTGPGTFMVYQIVMVYAHNATSAGRQNSNAFAYSKTQDVGSRVDLYYLSAITLDKKVIVQSGQAISPLDWNTVQRNVLMENYNTGSNNGHFSFDWSAYNDPHRRY

SEQ ID NO: 82 - protein, 271 aa, Artificial sequence
  variant of native sequence
MTIKEELGQPQSHSIELDSLSGEAGDIRAALTSNLAGSFDQYPTKSGDFQIDSYLLDYSAPKQGCWVNGITVYGDIYIGKQNWGTYTRPVFAYLQYMDTISIPQQVTQTRSYQLTKGHTQSFTTSVSAKYSVGAKIDIVNIGSEISTGFSQTESWSTTQTFTESTQLTGPGTFMVYQIVMVYAHNATSAGRQNSNAFAYSKTQDVGSRVDLYYLSAITLDKKVIVQSGQAISPLDWNTVQRNVLMENYNTGSNNGHFSFDWSAYNDPHRRY

SEQ ID NO: 83 - protein, 334 aa, Unknown
  Unknown organism from environmental sample
MVRVYPDFDEMIREAAQKWSEANGLLFQNVSYSDPLTNTDTFSLSVEFKDIGCLEECVELEKINVSQAFTNNTGQQQKETFETITYVEDEYTWENDYHFVLPGQNFLTMPRLPRSAHKDINPGFLVNFFGENQQFHTKMRERRPIRGELFLEPSSSATIQLQVEKYHISQPYEIELSILGSIIVTAQDRGQEQGTDRYVRLTDLIPFLCPHKNFFSKGRALIFLEQGTFTGILSRAIRAYATQTLHCDGKTLEYEIPLNNPLPESALQPKPMTTNATSCGCSSDRPSVVSTYSTYSHPANPTAYSQQPMTTDSTSCGCSSCMSARSNKTLYTNQ

SEQ ID NO: 84 - protein, 1247 aa, Unknown
  Unknown organism from environmental sample
VTGMNGGKNVNKNNQNEVQIVDSSSNDFNQSNSYPRYPLAEESNYKDWLANGKESNLDRLSTPSTVQDAIVTSLSIASYIISFLDGTIGAGLGILSVLFGQFWPSNTNTVWDNFLHVVEELINRRIDIVERERILRQFDGLRAVISNYNTAFRNWNENETTRNDPALQSEVRSRFDNADDAFANRMPEFRITGFETQSLAVYAQAATLHLLVLRDAVVNGRAWGFAQATIESLYTKLVCLINAYADHCTSVYRQGLQELRNRGNWRNFNNYRRDMTITVLDVISLFSNYDPRIYYYSTNTQLTREVCTEPIASSTWLNRYSNPDEFQQIENDLNPPPSLFSILTTLFARTAFFYYNDLHTPRDAISKTSMRLTRTDGTTIITTPWQGAFPPNISQELPRNFSGYKVYNVDSILANTAVQFTGIQRVVFHMVNEAGTGVPSQSIDLPLTTYYFNKSSNIPGIRSENPTGTDYTHILSSIRSTSVGTPYRDRSNIMVYGWTHTSAERTNRLLSSYGITQIPVVKANQLSNNARVISGPGHTGGALISMSGDSSIAMSLYVPKERYYIIRIRFVNDFNDVEGILEFQGTGITLNVKFPGSGAAVNPDLSVGDFRYVTIPAYPLIRGNTTYQVILKTRNATGTCLIDKIEFIPNSARALEYEGKQNLEKTKKAVADLFTNTGKEALKVDTTDYDVDQAANLVECVPEEPYAKEKMILLDEVKHAKQLSASRNLIQNGSFEFYTDEWTTSNNVSIQADNPIFKGNYLKMPGARETEGGTTRFPTYVLQKIDESKLKPYTRYKARGFVGSSHDVKLIVERYGKEVDALLNVRNNLALNTVAPSRIEANQCQSQPYPIIQDGCLTNVIDTNSYEEAQSGHANFKKEQGMCHQSHQFDFHIDTGEVHLNKNPGIWVLFKISSPEGHATLDNIELIEEGPLVGESLALVKKREKKWNNEMETRWIQTKEVYEKAKGAIDALFTDAQDQALKFDTNISHIISAEHLVQSMPYVYNKWISDVPGMNYDIYTELERRITQAYSLYERRNIIRNGDFNHDLNHWHATPHAKVQQIDGTAVLVIPNWSSNVSQNLCVEQNRGYVLRVTAKKEDPGKGYVTISDCNGNQETLTFTSCDNYVSNKITNDQSEYHFNQEMNEQRSYNPTETINEQLGYRLGQVSNEQRCYTRNAITNDQSEYHFSQEMNEQRSYNPIETMNEHRNYITRTIDFFPDTDQVRIDIGETEGTFKVESIELICRKSQ

SEQ ID NO: 85 - protein, 1238 aa, Artificial sequence
  variant of native sequence
MNKNNQNEVQIVDSSSNDFNQSNSYPRYPLAEESNYKDWLANGKESNLDRLSTPSTVQDAIVTSLSIASYIISFLDGTIGAGLGILSVLFGQFWPSNTNTVWDNFLHVVEELINRRIDIVERERILRQFDGLRAVISNYNTAFRNWNENETTRNDPALQSEVRSRFDNADDAFANRMPEFRITGFETQSLAVYAQAATLHLLVLRDAVVNGRAWGFAQATIESLYTKLVCLINAYADHCTSVYRQGLQELRNRGNWRNFNNYRRDMTITVLDVISLFSNYDPRIYYYSTNTQLTREVCTEPIASSTWLNRYSNPDEFQQIENDLNPPPSLFSILTTLFARTAFFYYNDLHTPRDAISKTSMRLTRTDGTTIITTPWQGAFPPNISQELPRNFSGYKVYNVDSILANTAVQFTGIQRVVFHMVNEAGTGVPSQSIDLPLTTYYFNKSSNIPGIRSENPTGTDYTHILSSIRSTSVGTPYRDRSNIMVYGWTHTSAERTNRLLSSYGITQIPVVKANQLSNNARVISGPGHTGGALISMSGDSSIAMSLYVPKERYYIIRIRFVNDFNDVEGILEFQGTGITLNVKFPGSGAAVNPDLSVGDFRYVTIPAYPLIRGNTTYQVILKTRNATGTCLIDKIEFIPNSARALEYEGKQNLEKTKKAVADLFTNTGKEALKVDTTDYDVDQAANLVECVPEEPYAKEKMILLDEVKHAKQLSASRNLIQNGSFEFYTDEWTTSNNVSIQADNPIFKGNYLKMPGARETEGGTTRFPTYVLQKIDESKLKPYTRYKARGFVGSSHDVKLIVERYGKEVDALLNVRNNLALNTVAPSRIEANQCQSQPYPIIQDGCLTNVIDTNSYEEAQSGHANFKKEQGMCHQSHQFDFHIDTGEVHLNKNPGIWVLFKISSPEGHATLDNIELIEEGPLVGESLALVKKREKKWNNEMETRWIQTKEVYEKAKGAIDALFTDAQDQALKFDTNISHIISAEHLVQSMPYVYNKWISDVPGMNYDIYTELERRITQAYSLYERRNIIRNGDFNHDLNHWHATPHAKVQQIDGTAVLVIPNWSSNVSQNLCVEQNRGYVLRVTAKKEDPGKGYVTISDCNGNQETLTFTSCDNYVSNKITNDQSEYHFNQEMNEQRSYNPTETINEQLGYRLGQVSNEQRCYTRNAITNDQSEYHFSQEMNEQRSYNPIETMNEHRNYITRTIDFFPDTDQVRIDIGETEGTFKVESIELICRKSQ

SEQ ID NO: 86 - protein, 641 aa, Artificial sequence
  variant of native sequence
MNKNNQNEVQIVDSSSNDFNQSNSYPRYPLAEESNYKDWLANGKESNLDRLSTPSTVQDAIVTSLSIASYIISFLDGTIGAGLGILSVLFGQFWPSNTNTVWDNFLHVVEELINRRIDIVERERILRQFDGLRAVISNYNTAFRNWNENETTRNDPALQSEVRSRFDNADDAFANRMPEFRITGFETQSLAVYAQAATLHLLVLRDAVVNGRAWGFAQATIESLYTKLVCLINAYADHCTSVYRQGLQELRNRGNWRNFNNYRRDMTITVLDVISLFSNYDPRIYYYSTNTQLTREVCTEPIASSTWLNRYSNPDEFQQIENDLNPPPSLFSILTTLFARTAFFYYNDLHTPRDAISKTSMRLTRTDGTTIITTPWQGAFPPNISQELPRNFSGYKVYNVDSILANTAVQFTGIQRVVFHMVNEAGTGVPSQSIDLPLTTYYFNKSSNIPGIRSENPTGTDYTHILSSIRSTSVGTPYRDRSNIMVYGWTHTSAERTNRLLSSYGITQIPVVKANQLSNNARVISGPGHTGGALISMSGDSSIAMSLYVPKERYYIIRIRFVNDFNDVEGILEFQGTGITLNVKFPGSGAAVNPDLSVGDFRYVTIPAYPLIRGNTTYQVILKTRNATGTCLIDKIEFIPN

SEQ ID NO: 87 - protein, 1294 aa, Bacillus sp.
MATLNELYPVPYNVLANPPMRLSTTDPNVLDAIEKIGGLFTDYSKDKKFGEIASTISEFYKAFSGDSVKWLEFTKGLLGIAGFYPPIGAAMPFINLFLNIFWPAEDKTAHLFKIIMEAVQKLVEQTFQSEILGNLQSEITGFQSNLQHFSDAISDAIVTIGTPPTVNKLIDVKSKFEVARGIIEAALPKFKNPLDSVSSNPTFQRESILLTLPLYTIAATMNLTLHQSYINFMDHWGILTYGSHEAYEDAIGMHRVKIDLRKRISTDSSTILSAFSQYMPPKQSTTKSAINTYIRYVRSMTTNSLDLVALWPTLYPDLYPKRTELDQTRSVFGDIIGPTEYNSNINIQVIDIYNNNRISSEIPSYSYPSSYSRLELSESNFHGYSSTSGPYTICAVDGVKLKYDGGAIFEYGPASNSKTIQNLQSLNMKSQIGATTQPHSDVDNTALYVNDSTWTVTSGCYDFLEDQMASSHNSSNNTVISNHKINTIYPVKTDSDDGGTQTSSKIGFLYSLILNDIAPTNSLDNKIQISNSSDLAIKAFPAEKGSLNNNIGTLQYVQEPLNGAAAVKLTSRQILQLPIINSNNLHYSIRIRYASNSNIDAYIHIETDNYSQGSGPISLPKTQVSVNDDDIYKDEKVMYTPGVDNKQYTSLLVMDSIEMFPGSSTVYIQNNSQEDLFLDRIEFIPISRLEFQDLSFSADRDDVKQIDGFISYYADLWQRKDTELGYVININPTSLESRCTYQFFNGENLVHEERNTASWAQGQTITVPEGFTKVRLNDFSASDAQLLYITGTININKPTFFALARDLEVITTQVNALFASGTQNKLTTDVSDYEIEEAVLKVDALSDEVFGNEKKALRKLVNQAKRLSKARNLLIGGSFDKLNAWYRGRHVVAVSDHELLKSDHILLPPPTLYPSYIFQKVEESKLKANTRYTVSGFIAHAIDLEIVVSRYGQEVKKVVQVPYGEAFPLTSSGPICCRPRSRVNGKPADPHFFSYSIDVGALDVEANPGIELGLRIVEPTGMARVSNLEIREDRPLTANELRKVQRAARDWRTAYDQERAEVTALIQPVLNQINALYENEDWNGTIRSRVSYHDLEAIVLPTLPKLNHWFMSDMLGEQGSILAQFQEALNRAYTQLEGSTLLHNGHFTTDAANWTIEGDAHHAILEDGRRVLRLPDWSSSISQTIEIENFDPDKEYQLVFHAQGEGTVTLEHGEETKYIETHTHHFANFTTSQRQGITFESNKVTVTISSEDGEFLADNIAIVEVPMFNKNQMVNENRGVNINSNTNMNSSNNQ

SEQ ID NO: 88 - protein, 686 aa, Artificial sequence
  variant of native sequence
MATLNELYPVPYNVLANPPMRLSTTDPNVLDAIEKIGGLFTDYSKDKKFGEIASTISEFYKAFSGDSVKWLEFTKGLLGIAGFYPPIGAAMPFINLFLNIFWPAEDKTAHLFKIIMEAVQKLVEQTFQSEILGNLQSEITGFQSNLQHFSDAISDAIVTIGTPPTVNKLIDVKSKFEVARGIIEAALPKFKNPLDSVSSNPTFQRESILLTLPLYTIAATMNLTLHQSYINFMDHWGILTYGSHEAYEDAIGMHRVKIDLRKRISTDSSTILSAFSQYMPPKQSTTKSAINTYIRYVRSMTTNSLDLVALWPTLYPDLYPKRTELDQTRSVFGDIIGPTEYNSNINIQVIDIYNNNRISSEIPSYSYPSSYSRLELSESNFHGYSSTSGPYTICAVDGVKLKYDGGAIFEYGPASNSKTIQNLQSLNMKSQIGATTQPHSDVDNTALYVNDSTWTVTSGCYDFLEDQMASSHNSSNNTVISNHKINTIYPVKTDSDDGGTQTSSKIGFLYSLILNDIAPTNSLDNKIQISNSSDLAIKAFPAEKGSLNNNIGTLQYVQEPLNGAAAVKLTSRQILQLPIINSNNLHYSIRIRYASNSNIDAYIHIETDNYSQGSGPISLPKTQVSVNDDDIYKDEKVMYTPGVDNKQYTSLLVMDSIEMFPGSSTVYIQNNSQEDLFLDRIEFIPI

SEQ ID NO: 89 - protein, 713 aa, Unknown
  Unknown organism from environmental sample
MNQNNDNKYEIIDSHASPYPSNRNIDQSRYPFTNNPNQPLQNTNYKNWINMCQQNQQCNGDIETLASADTISGVSAGIIVVGTLLGAFAAPIISSFIISFGTLLPLFWKSSEDKTIWEQFLIIGNRPFDSVVDQAIINLLSDKAKSLKAQFEDYQRYFDLWNQNKNSQNAGEVLRRFSSLDSDITRELEQLKGNYYITLLPGYANVANWHLNLLQHAAINYDKWISNSSTQNIYPEDYISDIDKECLDKCSTASGGSVSSAYYKCRLKCKIAAYTNYCSKTYQEGLNKLKNSNNIKWNIYNTYRREMTLTVLDLIALFPNYDIENYPIEIGTNTELTREIYTDALIANYANSHFSIEKIENSLTRYPDLVTWLHSIFFYTRTIFSPVPGQYEIGFTANAVRVSYTNGPIQPPSPIYGYYDGIDDKSEKVFSNQYIYKNRITYFRDDPGMVQEIHLDLTNRGTVSFTDTSPFPPNFQTNITLAIPGKDRSNPPTFNEYSHVLSYMKTAIGDERPFYSRARSICFGWMHFSVNNRNTISDKKITQIPAVKANRLDLPSFVMPGPGHTGGNLVVLSDRIEFQCNVPILAKYKIRMRYVAYSPNKSINLTLSIQGGGGSYIVQIPNIGSTVHSEQDTVNPKYQDFQYLYFNDPTGQPIIAQLFSTTNITLSTNRLASNTLIIDKIEFIPTTEAFEQTYEKQKLEKNQQTVNNLFEKR

SEQ ID NO: 90 - protein, 686 aa, Artificial sequence
  variant of native sequence
MNQNNDNKYEIIDSHASPYPSNRNIDQSRYPFTNNPNQPLQNTNYKNWINMCQQNQQCNGDIETLASADTISGVSAGIIVVGTLLGAFAAPIISSFIISFGTLLPLFWKSSEDKTIWEQFLIIGNRPFDSVVDQAIINLLSDKAKSLKAQFEDYQRYFDLWNQNKNSQNAGEVLRRFSSLDSDITRELEQLKGNYYITLLPGYANVANWHLNLLQHAAINYDKWISNSSTQNIYPEDYISDIDKECLDKCSTASGGSVSSAYYKCRLKCKIAAYTNYCSKTYQEGLNKLKNSNNIKWNIYNTYRREMTLTVLDLIALFPNYDIENYPIEIGTNTELTREIYTDALIANYANSHFSIEKIENSLTRYPDLVTWLHSIFFYTRTIFSPVPGQYEIGFTANAVRVSYTNGPIQPPSPIYGYYDGIDDKSEKVFSNQYIYKNRITYFRDDPGMVQEIHLDLTNRGTVSFTDTSPFPPNFQTNITLAIPGKDRSNPPTFNEYSHVLSYMKTAIGDERPFYSRARSICFGWMHFSVNNRNTISDKKITQIPAVKANRLDLPSFVMPGPGHTGGNLVVLSDRIEFQCNVPILAKYKIRMRYVAYSPNKSINLTLSIQGGGGSYIVQIPNIGSTVHSEQDTVNPKYQDFQYLYFNDPTGQPIIAQLFSTTNITLSTNRLASNTLIIDKIEFIPT

SEQ ID NO: 91 - protein, 859 aa, Bacillus sp.
MKNKKKYMKPLAVGLLATNIIGFGTQTVAFAATDKAGSKEQIQQQMKTQNKSFNPTVLASMPSDTSELQKMLEDAIKNKDTQITPELIKKLQDKGFDYLSIVKGLTGGLLKQIPYAGSILSPLVVGLFPGKGYVTKANVWGEIQDRVSNLIDQKLEESQVNNLIGKLTGIQDNLGIYQTRVGLVNGIKPPIANFIQKDANSDKNKENLRSTIDSLDKDLGRVIPEFAVKGYEAASLPYYVQVANVHLFLLKDALTHADEWGLTDDEKRGYLSRLQQKIQEYSSVVYDSFNKGVEAAKSKGGSTADNWNRTNAYVRTMTLYGLDFVAFWPAFDTKHYNQPVKLQQTRELYSNMIGRPINWQDYDTTLQQIHNSGYAGYPGELKQINVSQWDRIDGIKEVFDWTGDGSRDYTQQWGKPNKSGYSTSSPTVDDPAIGISAYESNDANHYNMSTITYKQNNAVRWLSGPFATKGDSKDGSRIDSKAPAGHKLSRVKVQEKRSDLNTISSFVAAYVPEEVHPQNILEATAITGVPAEKYLAHAGFENKIEYMNGSNAMVSSKNGDTIDYNVQSQGKQKYKIRLRVATNNDTSVGISINGNSQQVNIKNTEAATKLEDGITVKGVNGKYMLIEGPTVELNQGTNTIQLKNSGGAKITLDRIEFQPIGGDIRHWKQEGDKWYLYDENNKKLTGWQEINGLKYYLGKTGDGSGMNTEGEMATGWKKIDGVQYYFGKTGDGVGMRAEGEVAIGWKKIDGVQYYFGKTGDGSGMEHEGEMAKGFKKIDGVKYYFGKTGDGSGLNHEGEMAKGWRTIDGLKYYFNKTGDGSGMEHEGEMAIGDMTIDGVKHHFNKTGDGTGRDHEGELVW

SEQ ID NO: 92 - protein, 660 aa, Artificial sequence
  variant of native sequence
MKNKKKYMKPLAVGLLATNIIGFGTQTVAFAATDKAGSKEQIQQQMKTQNKSFNPTVLASMPSDTSELQKMLEDAIKNKDTQITPELIKKLQDKGFDYLSIVKGLTGGLLKQIPYAGSILSPLVVGLFPGKGYVTKANVWGEIQDRVSNLIDQKLEESQVNNLIGKLTGIQDNLGIYQTRVGLVNGIKPPIANFIQKDANSDKNKENLRSTIDSLDKDLGRVIPEFAVKGYEAASLPYYVQVANVHLFLLKDALTHADEWGLTDDEKRGYLSRLQQKIQEYSSVVYDSFNKGVEAAKSKGGSTADNWNRTNAYVRTMTLYGLDFVAFWPAFDTKHYNQPVKLQQTRELYSNMIGRPINWQDYDTTLQQIHNSGYAGYPGELKQINVSQWDRIDGIKEVFDWTGDGSRDYTQQWGKPNKSGYSTSSPTVDDPAIGISAYESNDANHYNMSTITYKQNNAVRWLSGPFATKGDSKDGSRIDSKAPAGHKLSRVKVQEKRSDLNTISSFVAAYVPEEVHPQNILEATAITGVPAEKYLAHAGFENKIEYMNGSNAMVSSKNGDTIDYNVQSQGKQKYKIRLRVATNNDTSVGISINGNSQQVNIKNTEAATKLEDGITVKGVNGKYMLIEGPTVELNQGTNTIQLKNSGGAKITLDRIEFQPI

SEQ ID NO: 93 - protein, 1291 aa, Bacillus sp.
LKHHEAILICSIYKRPQLLRNIKNIGGLYMNNNEFEIMDNGAMSYQSRYPLARKPGSEWQQMNYKDWMDMCTNGEAGDIFNDTAGAVRTGLIVGTGIAWALLGLIPVYGTAASAIAGLFNVLIPYWWPEQPGVQPGSPQAQFTWDQLMTAVEDLTDKKILESKRSNAIARWQGLQILGHDFYVALCDWTKDQDNDRKKEVLRQEFNDLNDALKLAMPHFGAQGFELPMLSMYAQAANMHLLVLKEVVQNGLRWGFEQYQVDRFYFDSTTPQGQGLLQLQANYTNYCVEWYERGLQEQYNTGNWHKFNDFRRNMTIMVLDTVAVWPTYDPRRYPYPTQSQLTRTVYTNPVGGAIRSRPDPIDIMENNMVSPPRLFSWLRKWEITTRKAGREGEQPCMSVKTLQNTLSSMQWSITQGESKPPIIKTLTLDIPNPYYQDDIWKVDTFRFDGINDGIAGWDFYFTKSADQHFPIFVVHPDSYVHRFNGLPCRGKDSGICDPCNFENPCRKETPNTSVPCEDKIQYSHRLSDIGAIFVASRYFDTDRLKSFGYGWTHVSADAKNLIDGSKKIIQIPAVKGKALYGEASVVRGPGSTGGDLVSLRPGGELVVTVTLPPPDQPGDFKSYVLGIRFANDLTTRLKVSYSDGYGESRSVIGTFGATSNPGPDGRLRFQSFAYRDFDTMWITQKEGLNEFDFTFENLGAVDGDGISNFQIDKLEFIPIERSLAEYQANQDIEKARKAVNALFTSDAKNALKLNVTDYAVDQAANLVECVSEEFHAQEKMILLDQVKYGKRLSQARNLLNYGDFESSDWSGENGWRTSHHVHVASDNPIFKGRYLHIPGAMSPQFSNKTYPTYAYQKVDESKLKSYTRYLVRGFVGNSKDLELLVERYGKDVHVEMDVPNDITYSLPINECGGSDRCKPASYQASPPHTCTCKDKENRNLTNRYTTEPTGSAVYLNRPDHKSCGCKNDDMYQNGTHLHKSCGCKDPHVFTYHIDTGYVDQEENLGLFFALKIASENGIANIDNLEIIEAQPLTGEALARVKKREQKWKQDMVQKRAQTEKAVQAAQGAIQTLFTNVQYNYLKFETLFPQIVHAEKLVQQIPYAYHPFLGEALPTVPGMNFEIIQQLLAVIGNAHALYEQRNLVRNGTFSSGTGNWHVTEGVKVQLLQDTSVLVLSEWSHGASQQLHIDPDRGYVLRVTARKEGGGKGTVTMSDCAAYTETVTFTSCDYNTVGSQMMTSGTLSGFVTKTLEIFPDTDRIQIDIGETEGTFQVESVELLCMKQMENAGNFEDEM

SEQ ID NO: 94 - protein, 689 aa, Artificial sequence
  variant of native sequence
MNNNEFEIMDNGAMSYQSRYPLARKPGSEWQQMNYKDWMDMCTNGEAGDIFNDTAGAVRTGLIVGTGIAWALLGLIPVYGTAASAIAGLFNVLIPYWWPEQPGVQPGSPQAQFTWDQLMTAVEDLTDKKILESKRSNAIARWQGLQILGHDFYVALCDWTKDQDNDRKKEVLRQEFNDLNDALKLAMPHFGAQGFELPMLSMYAQAANMHLLVLKEVVQNGLRWGFEQYQVDRFYFDSTTPQGQGLLQLQANYTNYCVEWYERGLQEQYNTGNWHKFNDFRRNMTIMVLDTVAVWPTYDPRRYPYPTQSQLTRTVYTNPVGGAIRSRPDPIDIMENNMVSPPRLFSWLRKWEITTRKAGREGEQPCMSVKTLQNTLSSMQWSITQGESKPPIIKTLTLDIPNPYYQDDIWKVDTFRFDGINDGIAGWDFYFTKSADQHFPIFVVHPDSYVHRFNGLPCRGKDSGICDPCNFENPCRKETPNTSVPCEDKIQYSHRLSDIGAIFVASRYFDTDRLKSFGYGWTHVSADAKNLIDGSKKIIQIPAVKGKALYGEASVVRGPGSTGGDLVSLRPGGELVVTVTLPPPDQPGDFKSYVLGIRFANDLTTRLKVSYSDGYGESRSVIGTFGATSNPGPDGRLRFQSFAYRDFDTMWITQKEGLNEFDFTFENLGAVDGDGISNFQIDKLEFIPI

SEQ ID NO: 95 - protein, 1262 aa, Artificial sequence
  variant of native sequence
MNNNEFEIMDNGAMSYQSRYPLARKPGSEWQQMNYKDWMDMCTNGEAGDIFNDTAGAVRTGLIVGTGIAWALLGLIPVYGTAASAIAGLFNVLIPYWWPEQPGVQPGSPQAQFTWDQLMTAVEDLTDKKILESKRSNAIARWQGLQILGHDFYVALCDWTKDQDNDRKKEVLRQEFNDLNDALKLAMPHFGAQGFELPMLSMYAQAANMHLLVLKEVVQNGLRWGFEQYQVDRFYFDSTTPQGQGLLQLQANYTNYCVEWYERGLQEQYNTGNWHKFNDFRRNMTIMVLDTVAVWPTYDPRRYPYPTQSQLTRTVYTNPVGGAIRSRPDPIDIMENNMVSPPRLFSWLRKWEITTRKAGREGEQPCMSVKTLQNTLSSMQWSITQGESKPPIIKTLTLDIPNPYYQDDIWKVDTFRFDGINDGIAGWDFYFTKSADQHFPIFVVHPDSYVHRFNGLPCRGKDSGICDPCNFENPCRKETPNTSVPCEDKIQYSHRLSDIGAIFVASRYFDTDRLKSFGYGWTHVSADAKNLIDGSKKIIQIPAVKGKALYGEASVVRGPGSTGGDLVSLRPGGELVVTVTLPPPDQPGDFKSYVLGIRFANDLTTRLKVSYSDGYGESRSVIGTFGATSNPGPDGRLRFQSFAYRDFDTMWITQKEGLNEFDFTFENLGAVDGDGISNFQIDKLEFIPIERSLAEYQANQDIEKARKAVNALFTSDAKNALKLNVTDYAVDQAANLVECVSEEFHAQEKMILLDQVKYGKRLSQARNLLNYGDFESSDWSGENGWRTSHHVHVASDNPIFKGRYLHIPGAMSPQFSNKTYPTYAYQKVDESKLKSYTRYLVRGFVGNSKDLELLVERYGKDVHVEMDVPNDITYSLPINECGGSDRCKPASYQASPPHTCTCKDKENRNLTNRYTTEPTGSAVYLNRPDHKSCGCKNDDMYQNGTHLHKSCGCKDPHVFTYHIDTGYVDQEENLGLFFALKIASENGIANIDNLEIIEAQPLTGEALARVKKREQKWKQDMVQKRAQTEKAVQAAQGAIQTLFTNVQYNYLKFETLFPQIVHAEKLVQQIPYAYHPFLGEALPTVPGMNFEIIQQLLAVIGNAHALYEQRNLVRNGTFSSGTGNWHVTEGVKVQLLQDTSVLVLSEWSHGASQQLHIDPDRGYVLRVTARKEGGGKGTVTMSDCAAYTETVTFTSCDYNTVGSQMMTSGTLSGFVTKTLEIFPDTDRIQIDIGETEGTFQVESVELLCMKQMENAGNFEDEM

SEQ ID NO: 96 - protein, 349 aa, Bacillus sp.
MINNQFFLDTTYTIANKKSNFLFDIQKESTSNGTPIVLNTPDSKKNQQFIFFKLDGELYTIANLSSGKIIDLTGSNHSHILVQNTWNGESSQIWYINHSDISESDYKIINHQNGKVVQSISDPNDMKNLITLTSWNNQDTQQWNFISKESIELPNISESKPLPLPPDYFSNIYEVLPLQTNPVIISSILLPCILIHDNEWDYPTKIQNSPYYKFVKEQYWERVQSITLEPGQTNTFQYKTGIKASDQKSMINTLGMSIGTDLGFQFNKSSTKISTQFTTTLKTLKSITSEQLSEITINDSITNIKSTKIGITKYQLVTLYSLFRTDNSLVTEPWKIRDHLTTKDRSISN

SEQ ID NO: 97 - protein, 560 aa, Bacillus sp.
MVQNNLEIKALPSFIDNFNGVFGFVENIVGIFDKIFGTNTGNENLELEEILRNQELLNELRDKLTGISGDLDSIIKNGEMNTELLNQLIQLSNKQGDMLQNIQSQIDSLQSMIAGYMAEITGMLKQIQIQNNILSAQMVYITEILLAISQKLDTINVNLLVNATITEITPSYQRMKYINKKYDELSASHIENYSKFTQDNSNGISLDTEDLRKLNELIELATSITHNSQNSFEFYLETFQDIMVGQTLFERSALQSIGELIRSDQTPKGYGSEVAKAYTFLTSLTSIQAKSYATLAACRKILGLSDIDYTPILTDYIQKQINIFKLEELPRFSDEFVGFNHIDTEGGGDLSKDYSFSVEANPGYALVGFEIIKNNTDYDLISYQAKLKQNYEVDAETISKITVSQINKVFGSRYDAKHEMFADQVGFMPGDLQFPKDYVITKLDFLAPVNTVGFLYEVTANHYDPVTGKIDVTTSLTKNPEDEEGTQFIDVKANANHGVYLPSKIIDTFLSPMYSFKIDADPDTSKFDISCKNYLSHYLEASDLNNKETSLPYIIDDTKK

SEQ ID NO: 98 - protein, 651 aa, Unknown
  Unknown organism from environmental sample
MNNKSNKNEIINSRFPVNFPNRNNRDLAYFVVNNQNSTLLDKNSKGWLVNCDKNTLVNIDPTGAATALSIATVAVGTVLILGFPVVGTILVLFGTILPIFWSDPSDNQSVWEDFIKMTEESTQYSITGSIRITALSHLRGLQTNLYEFYNTFVTWESNQTDPSALSRLLRAFDDLNTTFRSAMPHFSPKDPEINQIENQIILLPTYAYVAFMHLITLSTASIYGKSWGMSDNVIADYEREQSKLLNEYTSYCTDTYFLGLFRLSIRGNTDWNKYNTYRRNMTISVLDIVAQFQYCDKRKYPMQVKPELTREIYTDALSFDGSLIEYYNLGLADEKLTRKPHLFTWLTGLDFYQLNTNAPNNFFTSHRNVIETTYGQRDYSPVFGNQNSDDLLLESGRAIIPYDEFIYSLTTLNFLSTHPDEYNNINEIKFSVTNGETTRPINIKPVTQVTRNLITNTWSLPPRDQSYILGPTNYSHTLSFVKAFNSSNVRRSIVYSFAWNHFSVNDINQIYLDSITTVPAVKAFSLGNSSIVFEGPGHTGGDMINLRDSMEFRCRSASNSKSYFIRLRYAANTPMVVSITLPGISGQSMRLNQTFSGNNYTALKYNELNYLQFPNEVIIPSNRLFNIILQKIYFQTDEVLIIDKIEFLPIS

SEQ ID NO: 99 - protein, 1165 aa, Unknown
  Unknown organism from environmental sample
MDGNYQSQCGPYNCFSNSEAIILDEERLEVGNTVADFSLGLINFLYSNFAPGGGFVVGLLELIWGILGPSQWGIFLNQIEQMINQRIEEFARNQAISRMEGLGNLYNVYTEAFKAWEADPDNPALKEEMRIQFNDMNSALITAIPLLRVQNYEVALLSVYTQAANLHLSVLRDVSVFGQNWGFDMATINSRYSELTRLIHVYTDHCVDTYNEGLKNLEGPRLGSWVVYNRFRRRLTISVLDIIAFFPNYDIKAYPIQTTTQLTREIYLDLPFVNENVSDSRYFPSFSTVENAIIRRPHLVDFLGRLTVFTDRWSARLFWGGHRVRFSRTGTTAFIDSPIYGVEASVERPIIFSPSKDVPKIRTLSYSSQLEDRVPDVVVEGVEFQDTQQISEIYRKSGPIDSLSELPPENTSVPLALGYSHRLCHANFLRQDGAPRIGGLVFSWTHRSASPTNEISSSRITQIPLVKAHTLGVNASVLKGPGFTGGDILYQNRLGSLGTIRMNFTGRFPQIYYIRIRYASPRNTSGFIVNSEMPYDSYPISFLKTMEIDRPLTSRSFALASIDIPITIRRYQVDFELTLQSGVYIDRIEFVPADATFEAEYDLERVQKAVNALFTSTNQKGLQTDVTDYHIDQVSNLVDCLFDEFCLDEKRELSEKVKQAKRLSDERNLLQDSNFRGINREQDRGWRGSTDITIQGGNDVFKENYVTLPGAFDECYPTYLYQKIDESKLKAYTRYQLRGYLEDSQDLEIYLIRYNAKHETLNVPGTGSLWPLAVENPIGRCGEPNRCAPHIEWNPDLDCSCGDGEKCAHHSHQFSLDIDVGCTDLNEDLGVWVIFKIKTQDGYARLGNLEFLEEKPLVGEALSRVKRAEKKWRDKREKLQLETNIVYKEAKESVDALFVNSRYDRLQADTNIAMIHAADKRVHRIRGAYLPELSVIPVVNAGIFEELEGLIFNAFSLYDARNVIKNGDFNNGLSYWNVKGHVDVQQNNHRSVLVLPEWKAEVSQEVRVCPGRGYILRVTAYKEGYGEGCITIHEIENHTDKLKFRNCEEEEIYPTNTVTCHDYTVSQGAEGCADTCNSRHRGYDEANGNNPSVSANYTPVFEEEVYTDGRRDNPCEMERGYTPLPVGYVTKELEYFPETDTVWIEIGETEGTFIVDSVELLLMEE

SEQ ID NO: 100 - protein, 593 aa, Artificial sequence
  variant of native sequence
MDGNYQSQCGPYNCFSNSEAIILDEERLEVGNTVADFSLGLINFLYSNFAPGGGFVVGLLELIWGILGPSQWGIFLNQIEQMINQRIEEFARNQAISRMEGLGNLYNVYTEAFKAWEADPDNPALKEEMRIQFNDMNSALITAIPLLRVQNYEVALLSVYTQAANLHLSVLRDVSVFGQNWGFDMATINSRYSELTRLIHVYTDHCVDTYNEGLKNLEGPRLGSWVVYNRFRRRLTISVLDIIAFFPNYDIKAYPIQTTTQLTREIYLDLPFVNENVSDSRYFPSFSTVENAIIRRPHLVDFLGRLTVFTDRWSARLFWGGHRVRFSRTGTTAFIDSPIYGVEASVERPIIFSPSKDVPKIRTLSYSSQLEDRVPDVVVEGVEFQDTQQISEIYRKSGPIDSLSELPPENTSVPLALGYSHRLCHANFLRQDGAPRIGGLVFSWTHRSASPTNEISSSRITQIPLVKAHTLGVNASVLKGPGFTGGDILYQNRLGSLGTIRMNFTGRFPQIYYIRIRYASPRNTSGFIVNSEMPYDSYPISFLKTMEIDRPLTSRSFALASIDIPITIRRYQVDFELTLQSGVYIDRIEFVPA

SEQ ID NO: 101 - protein, 1280 aa, Unknown
  Unknown organism from environmental sample
MNQNYNNNEYEIKDVGVMDYQPRYPLAQAPSAELQQMSYKDWMDRCERGSLAITFKSVITTALDITSAILGAAKSPKAKVARAAVQVLNSVIKLLWPEPEKPSEPAYDIDFIWKELIKRVEILIEEKIDREAYNAAIGRLSGLKRALNLYQIAFWDWLKDENDPELQAELRTRFTAALFELVTTIETFKYNGQELNLLTIFVQAADFHLMLLQQGIMYGVRWGFDQRTVDSLYQNDSGEGLKNLLPKYSDYATYWYGQGLNRAKNLKANLSDTVRYPWAANLEDTSVLQELEDWNLYNDYRRDMTILVLDLVAVWPTYDLHYYDNGNYGVQSELTRSIYSQAVGNVMGTVFTKEQYEVSFVRPPHLVTWLEKMFVHIRDKEQGAPNDAEMAGISLDYSYSGWDNTVYDILQGYPATGGSQIRVLAKSNVIVQDQEKNRAIYNTDLQHDKLVDRFVFYQNSGEVNYAGRDNPSSYKTFAWDTDVTNYSSQMTWINGPVNEGHFGYIQAYAPEWIPASCEPFNTIVDAEDVITQIPAVKARELKYGARVIKGLGYTGGDLVSIAPNGLCELYVSFPNVARRYQVRVHYACQDSTKIKLRIGDSSHDIKLQSTYSGGALTYDSFGYATSEYSYLFYPDFYDEKQIVRLGNDFDITQQDIIIDKIEFIPVDIFYAEEQALKQARKAVNALFTGDAKDVLKLNVTDYAVDQAANLVECVSDEFHAQEKMILLDQVKFAKRLSQARNLLHYGDFESLDWSGENGWRTSHHVSVRSDNPIFKGRYLHMPGATSSQFSNNVYPTYVYQKVDESKLKSYTRYLVRGFVGNSKDLELLVERYGKDVHVEMDVPNDIRYSLPMNECGGFDRCKSASDQTRPPHTCTCKNTAVAHTDCQCQDKGNRISTGVYTNGPTGSAVYTNGFHTHQSCGCKNKNSDRYQSGTHPQKSCGCKDPHVFSYHIDTGCVDQEENLGLWFALKVASENGVANIDNLEIIEAQPLTGEALARVKKREQKWKQEMAQKRFQTDKAVQAAQGAIQPLFTNAQYNRLQFETLFPQIVNAEMLVQQIPYMYHPFLSGALPTVPGMNFEIIQRLLAVTGNARGLYEQRNLVRNGTFSSGTGNWHVTEGVKVQPLQNTSVLVLSEWNQEASQQLHIDPDRGYVLRVTARKEGGGKGTVTMSDCAAYTETLTFTSCDFNTSGSQTMTSGTLSGFVTKTLEIFPDTDRIRIDMGETEGTFQIESVELICMEQMEDDLYDMAGNLEEEMLDLGIENINAVTNKMCFSWDIQCP

SEQ ID NO: 102 - protein, 666 aa, Artificial sequence
  variant of native sequence
MNQNYNNNEYEIKDVGVMDYQPRYPLAQAPSAELQQMSYKDWMDRCERGSLAITFKSVITTALDITSAILGAAKSPKAKVARAAVQVLNSVIKLLWPEPEKPSEPAYDIDFIWKELIKRVEILIEEKIDREAYNAAIGRLSGLKRALNLYQIAFWDWLKDENDPELQAELRTRFTAALFELVTTIETFKYNGQELNLLTIFVQAADFHLMLLQQGIMYGVRWGFDQRTVDSLYQNDSGEGLKNLLPKYSDYATYWYGQGLNRAKNLKANLSDTVRYPWAANLEDTSVLQELEDWNLYNDYRRDMTILVLDLVAVWPTYDLHYYDNGNYGVQSELTRSIYSQAVGNVMGTVFTKEQYEVSFVRPPHLVTWLEKMFVHIRDKEQGAPNDAEMAGISLDYSYSGWDNTVYDILQGYPATGGSQIRVLAKSNVIVQDQEKNRAIYNTDLQHDKLVDRFVFYQNSGEVNYAGRDNPSSYKTFAWDTDVTNYSSQMTWINGPVNEGHFGYIQAYAPEWIPASCEPFNTIVDAEDVITQIPAVKARELKYGARVIKGLGYTGGDLVSIAPNGLCELYVSFPNVARRYQVRVHYACQDSTKIKLRIGDSSHDIKLQSTYSGGALTYDSFGYATSEYSYLFYPDFYDEKQIVRLGNDFDITQQDIIIDKIEFIPV

SEQ ID NO: 103 - protein, 123 aa, Unknown
  Unknown organism from environmental sample
MEKKQECCEEVNTKALFCCRVQVPHSFPYMPNSASKIAYNLDCLSVVEESCRKTIQVEDCGAVEVKLNLLKVVGFIPYIANATVEGEHGKECDYDANGRHQVSVCCNGSIFIVYKSEHKCKKT

SEQ ID NO: 104 - protein, 811 aa, Unknown
  Unknown organism from environmental sample
MNLNDNKNEFEIMGNGSMAYQPRYPLAQAPGSAFQGMDYKDWLNLCASGEFGELFVDSDAVKNGVVAGLAITSYILSIPFPFQSAALGIISILLPILWPEQAGNPGTTEAQFTWDQWMKAAENMADQKIADSVKTSAINTTKTLQSRIDDYTQAICNLKTDPNNEAYKEEVRRQFNDADDWAKATVIEFGNSAYAIPLLADYAQAANLHLLLLQEGIKFGESWGFSALKVQQLYSNTSVGNPGMKELLAIYTDHCVRYYNEGLKKRYETGNWYTFNDYRKNMTLMVMDIVSFWPTYDPILYPVPTKSQLTRTVYTDFLRDTISPPAISDVENSVTVPLGLFRWMIGLGYHGVTVNSSNVWMGLEQLYHYTLRGDRYEERQGEFPHDSKLLGYLATANDDVWSIIPNYIPIEDGSEVGYIPNTASFFHDFRFQLLKSEEQRVHLAYEEGISRKFGLPCKSNTGTDCDPCQPCTALPNASDPCDDKSLYSHRFSYMGIYNPYIEFTLSPCFGWTHVSADANNLIDAEKITQIPAVKAYAIATNSRVVKGPGSTGGDVVQLSSGTERGIISMWITTPPGALAYRVRIRYASSMQTNVEIYMLGANGQFDVPATTTDLTNLTYNKFKYLDTVVYSYSEVEENREHIRIGATGSGSGSFILDKIEFIPIRGSVEEFEANQALEKARKEVNALFTGDAKSALKLNITDYAVDQASNLVECVSDEFHAQEKMILVDQVKYAKRLSHARNLLNYGDFESSDWSGENGWKTSHHVHVTANNPIFKGRYLHMPGATSSQFSKNLFRIYGIICTKKDVSYDT

SEQ ID NO: 105 - protein, 664 aa, Artificial sequence
  variant of native sequence
MNLNDNKNEFEIMGNGSMAYQPRYPLAQAPGSAFQGMDYKDWLNLCASGEFGELFVDSDAVKNGVVAGLAITSYILSIPFPFQSAALGIISILLPILWPEQAGNPGTTEAQFTWDQWMKAAENMADQKIADSVKTSAINTTKTLQSRIDDYTQAICNLKTDPNNEAYKEEVRRQFNDADDWAKATVIEFGNSAYAIPLLADYAQAANLHLLLLQEGIKFGESWGFSALKVQQLYSNTSVGNPGMKELLAIYTDHCVRYYNEGLKKRYETGNWYTFNDYRKNMTLMVMDIVSFWPTYDPILYPVPTKSQLTRTVYTDFLRDTISPPAISDVENSVTVPLGLFRWMIGLGYHGVTVNSSNVWMGLEQLYHYTLRGDRYEERQGEFPHDSKLLGYLATANDDVWSIIPNYIPIEDGSEVGYIPNTASFFHDFRFQLLKSEEQRVHLAYEEGISRKFGLPCKSNTGTDCDPCQPCTALPNASDPCDDKSLYSHRFSYMGIYNPYIEFTLSPCFGWTHVSADANNLIDAEKITQIPAVKAYAIATNSRVVKGPGSTGGDVVQLSSGTERGIISMWITTPPGALAYRVRIRYASSMQTNVEIYMLGANGQFDVPATTTDLTNLTYNKFKYLDTVVYSYSEVEENREHIRIGATGSGSGSFILDKIEFIPI

SEQ ID NO: 106 - protein, 325 aa, Unknown
  Unknown organism from environmental sample
MVFLYNFVTLGTLISNLFLGSDVKMNRKVILCGVLASTLLGGGTLSTNVSAAEIEENKNSIINTPASKSQKVMNDINQEAIQDIDQKVNKMIDSIPPIFGSKYTRTDRFYGESLTYSGINLEENNSTHVEPMYFGSNTFYNDSELEQSYNTTSFSEAVTKSTTTQTQNGFKSGVTTGGEVGIPFVAKGEVKINLEYNFTHTNSNTTSKTTTLTAPPQPVKVPAGKVYKTDVYFEKKSTSGTVELYADFLTGVVAEGRVAPIGSVLYKANDKQGLIQSPNDPSKVRAIGKGTFNVEHGSNFIVKTYDVTSKGKTAKLVDTKVIPIK

SEQ ID NO: 107 - protein, 275 aa, Artificial sequence
  variant of native sequence
MAEIEENKNSIINTPASKSQKVMNDINQEAIQDIDQKVNKMIDSIPPIFGSKYTRTDRFYGESLTYSGINLEENNSTHVEPMYFGSNTFYNDSELEQSYNTTSFSEAVTKSTTTQTQNGFKSGVTTGGEVGIPFVAKGEVKINLEYNFTHTNSNTTSKTTTLTAPPQPVKVPAGKVYKTDVYFEKKSTSGTVELYADFLTGVVAEGRVAPIGSVLYKANDKQGLIQSPNDPSKVRAIGKGTFNVEHGSNFIVKTYDVTSKGKTAKLVDTKVIPIK

SEQ ID NO: 108 - protein, 301 aa, Artificial sequence
  variant of native sequence
MNRKVILCGVLASTLLGGGTLSTNVSAAEIEENKNSIINTPASKSQKVMNDINQEAIQDIDQKVNKMIDSIPPIFGSKYTRTDRFYGESLTYSGINLEENNSTHVEPMYFGSNTFYNDSELEQSYNTTSFSEAVTKSTTTQTQNGFKSGVTTGGEVGIPFVAKGEVKINLEYNFTHTNSNTTSKTTTLTAPPQPVKVPAGKVYKTDVYFEKKSTSGTVELYADFLTGVVAEGRVAPIGSVLYKANDKQGLIQSPNDPSKVRAIGKGTFNVEHGSNFIVKTYDVTSKGKTAKLVDTKVIPIK

SEQ ID NO: 109 - protein, 656 aa, Unknown
  Unknown organism from environmental sample
VENMNSYENKSEYEILNASPNNTNMPNRYPFANDPNIFPINLNDCQGKPWQNTWKSVSDILSAAFTLWRFLQAPSPALGATALLGVINILIPPAGPSVASLSICDLLSIIRKEVDQSVLDDGVADFNGKLTNYKEYYLSSLQEWLSAGKPNDKRLSNVVEYFKKSEEGFNEILAGSLSRENARILLLPTFAQAANFQLLLLRDAVQYKKEWGALLSAEKVGSELISPTIDYGQRLKDKIAQYTKYCVTWYQEGLNQIKEGGARTETWLKFNKFRREMTLAVLDIIALFPTYDFAKYPLGTSVELTREIYTDPVGYSGGTYGWEQFFSFNSLEANGTRGPGLVTWLLAIDIYSHSVLSLTGWGGTRHYEDYTKGNGAFQRMSGTTSNDPHPISFGTTDIFKISSLARYVLQQFPGFIVPRHLVSRAEFFPTTPNTLLYERNSSGNSQTIESVLPGIDNDLPPSRTNYSHRLSNAACVQYETSVVTVFGWTHTSMTRNNPIHPDKITQIPAVKAFALENNAYVSAGPGDTGGDVVTLRYHGRLKIRLTPAPTNKDYLVRIRYSALAYGAVYVERWSPSGSVYDVFPLPYTSVSTYGYVDTLVTTFNQSSVEIIIENRHISDIIIDKVEFIPQDSTALEYEGKQSLEKAQNVVNDLFIN

SEQ ID NO: 110 - protein, 627 aa, Artificial sequence
  variant of native sequence
MNSYENKSEYEILNASPNNTNMPNRYPFANDPNIFPINLNDCQGKPWQNTWKSVSDILSAAFTLWRFLQAPSPALGATALLGVINILIPPAGPSVASLSICDLLSIIRKEVDQSVLDDGVADFNGKLTNYKEYYLSSLQEWLSAGKPNDKRLSNVVEYFKKSEEGFNEILAGSLSRENARILLLPTFAQAANFQLLLLRDAVQYKKEWGALLSAEKVGSELISPTIDYGQRLKDKIAQYTKYCVTWYQEGLNQIKEGGARTETWLKFNKFRREMTLAVLDIIALFPTYDFAKYPLGTSVELTREIYTDPVGYSGGTYGWEQFFSFNSLEANGTRGPGLVTWLLAIDIYSHSVLSLTGWGGTRHYEDYTKGNGAFQRMSGTTSNDPHPISFGTTDIFKISSLARYVLQQFPGFIVPRHLVSRAEFFPTTPNTLLYERNSSGNSQTIESVLPGIDNDLPPSRTNYSHRLSNAACVQYETSVVTVFGWTHTSMTRNNPIHPDKITQIPAVKAFALENNAYVSAGPGDTGGDVVTLRYHGRLKIRLTPAPTNKDYLVRIRYSALAYGAVYVERWSPSGSVYDVFPLPYTSVSTYGYVDTLVTTFNQSSVEIIIENRHISDIIIDKVEFIPQ

SEQ ID NO: 111 - protein, 653 aa, Artificial sequence
  variant of native sequence
MNSYENKSEYEILNASPNNTNMPNRYPFANDPNIFPINLNDCQGKPWQNTWKSVSDILSAAFTLWRFLQAPSPALGATALLGVINILIPPAGPSVASLSICDLLSIIRKEVDQSVLDDGVADFNGKLTNYKEYYLSSLQEWLSAGKPNDKRLSNVVEYFKKSEEGFNEILAGSLSRENARILLLPTFAQAANFQLLLLRDAVQYKKEWGALLSAEKVGSELISPTIDYGQRLKDKIAQYTKYCVTWYQEGLNQIKEGGARTETWLKFNKFRREMTLAVLDIIALFPTYDFAKYPLGTSVELTREIYTDPVGYSGGTYGWEQFFSFNSLEANGTRGPGLVTWLLAIDIYSHSVLSLTGWGGTRHYEDYTKGNGAFQRMSGTTSNDPHPISFGTTDIFKISSLARYVLQQFPGFIVPRHLVSRAEFFPTTPNTLLYERNSSGNSQTIESVLPGIDNDLPPSRTNYSHRLSNAACVQYETSVVTVFGWTHTSMTRNNPIHPDKITQIPAVKAFALENNAYVSAGPGDTGGDVVTLRYHGRLKIRLTPAPTNKDYLVRIRYSALAYGAVYVERWSPSGSVYDVFPLPYTSVSTYGYVDTLVTTFNQSSVEIIIENRHISDIIIDKVEFIPQDSTALEYEGKQSLEKAQNVVNDLFIN

SEQ ID NO: 112 - protein, 564 aa, Unknown
  Unknown organism from environmental sample
VNPMFPSGTKNTLSIETTDYEIDQAAISIECMSDEQNSQEKMVLWDEVKRAKQLSQSRNLLQNGDFGEFSGNDWTFSNDIIIGSNNSIFKGNFLQMRGARDIYGTIFPTYIYQKIDESKLKPYTRYRVRGFVGSSKDLKLMVTRYGKEIDAIMNVSNDLAYMQPNPSCGDYRCEPSSQYVSQGGYPTPTDGYALDMYACPSSSDKKHVMCHDRHPFDFHIDTGEVDANTNVGIDVLFKISNPDGYATVGNLEVIEEGPLTSEALSHVKQKEMKWHQHMEKKRWETQQAYDRAKQAVDALFTNAQGEALHYHTTLDQIQNADRLVQSIPYVNHAWLPNAPGINYDVYQGLNARIMQARYLYDARNVITNGDFTQGLTGWHATGKAAVQQMDGSSVLVLSNWSAGVSQNLHAQNHRGYMLRVIAKKEGPGKGYVTMMDCNGKQETLKFTSCEEGYMTKTVEVFPESDRIRIEMGETEGTFYIDSIELLCMKGYNNPHTGNMYEQSYNGNYHQNTSDVYHQGYTNNYNQDSSSMYNQNYTNNDDLHSGCTCNQGHNSGCTCGQEYNR

SEQ ID NO: 113 - protein, 384 aa, Bacillus sp.
MKSISKKVVTGLFAGAMGLSIFAPASQAAPANNEYTYIALKADQHQLWDVYEGATYDNAGIRLYADAGTPDNRKFLLVPLDGGTYAIVNKNSGKPVSVGSGWVGPGIQKNDILTQQSWTGSATQQWYLRDKGNDYYEIVNQGYGKVASWGWNGVTGAASIQYVDLDDSDPSDSNRVFKIPRSWDTFSLPTLPATGTRPDAPNYTGGIDQQLPQTSNSVVVGASLIPSIMVKDSQASDYTKIHNSPYYTLVKEEYWDKTFSAVIPAGLTRSYTFKSGMTSTDQQKMTDTLSISVGADFGFKFKDATAAIKTSLTKTLQTEISSTSTEASEETVSSTVTSEPGKTTGFTEYQLVTKYSLKRADGSTVSDPWIVKNNKITVARKNSI

SEQ ID NO: 114 - protein, 355 aa, Artificial sequence
  variant of native sequence
MANNEYTYIALKADQHQLWDVYEGATYDNAGIRLYADAGTPDNRKFLLVPLDGGTYAIVNKNSGKPVSVGSGWVGPGIQKNDILTQQSWTGSATQQWYLRDKGNDYYEIVNQGYGKVASWGWNGVTGAASIQYVDLDDSDPSDSNRVFKIPRSWDTFSLPTLPATGTRPDAPNYTGGIDQQLPQTSNSVVVGASLIPSIMVKDSQASDYTKIHNSPYYTLVKEEYWDKTFSAVIPAGLTRSYTFKSGMTSTDQQKMTDTLSISVGADFGFKFKDATAAIKTSLTKTLQTEISSTSTEASEETVSSTVTSEPGKTTGFTEYQLVTKYSLKRADGSTVSDPWIVKNNKITVARKNSI

SEQ ID NO: 115 - protein, 592 aa, Bacillus sp.
MKYKDRKHAKCKYKPALLATVATMTLGVSTFGSTASVFAAENSINSQQATSTPATNDDVFKVEKDGTIKILKDKLFTTDNLKAIGSLGGSVLKQAYTDAHTNNGNFNNTFRTLTMGTTALIPYGGVVISPLIGLLWPENVDAQKNQIKKMMEELATMMDQKIEDYDLGTLKQQTKALMNDLQSFEDSINGRPLAKSPTAGSIEETRRTQALIINAKFKEIIQLCQKEDQKIAELPIFTIIATAHLEFLHFMEKNGQGSKIKFDDESLKTQFTNDIPKITEDYIHHVQQTYKLGKQQFNKKMYDVAANTPGGNANANSTSEEEIIGKMQKYILDLHPLANGYGEKRRQMQDALTNYGKLRDTRNQYYKNTSNNEAFQLVALGDWKKENNGWYFIDTKGKKKIGWIQLGEKHYYLSPSDGKMVTGSVAIKTSDGRTGTYQFNSSGECTNYDTASPNGTYKIVYSKANKVVDFGYDGKEHPVIWDYHDGKNQQWEFKYDAEKNAYQIINKDDERVLAYNTSGASDTALVTRNDHKPEHYWTLEDAGDGNVLLVNYADKNKVLDVYGEKTAGGSRLFVRDKLNNSAAQKFKLVKIS

SEQ ID NO: 116 - protein, 554 aa, Artificial sequence
  variant of native sequence
MAENSINSQQATSTPATNDDVFKVEKDGTIKILKDKLFTTDNLKAIGSLGGSVLKQAYTDAHTNNGNFNNTFRTLTMGTTALIPYGGVVISPLIGLLWPENVDAQKNQIKKMMEELATMMDQKIEDYDLGTLKQQTKALMNDLQSFEDSINGRPLAKSPTAGSIEETRRTQALIINAKFKEIIQLCQKEDQKIAELPIFTIIATAHLEFLHFMEKNGQGSKIKFDDESLKTQFTNDIPKITEDYIHHVQQTYKLGKQQFNKKMYDVAANTPGGNANANSTSEEEIIGKMQKYILDLHPLANGYGEKRRQMQDALTNYGKLRDTRNQYYKNTSNNEAFQLVALGDWKKENNGWYFIDTKGKKKIGWIQLGEKHYYLSPSDGKMVTGSVAIKTSDGRTGTYQFNSSGECTNYDTASPNGTYKIVYSKANKVVDFGYDGKEHPVIWDYHDGKNQQWEFKYDAEKNAYQIINKDDERVLAYNTSGASDTALVTRNDHKPEHYWTLEDAGDGNVLLVNYADKNKVLDVYGEKTAGGSRLFVRDKLNNSAAQKFKLVKIS

SEQ ID NO: 117 - protein, 1326 aa, Unknown
  Unknown organism from environmental sample
LKGEISMTTLSYYNVLAYPPLILDEKSPYDQYKEWQKKIDKTWKEYDEDFLPKPVMDLGKNLAEVFKGDPQAYLHLANTAIRLAFLIIPGGQTAAWGVNLVLNKVVGIFFPPQNKSLFDQIKDAVSNLVDQKLIDQEINGLMIKLNSLNQPLSRFGNSIQRAIGKPQDFETTSSNAIILDATQDCSKDSACSCSNDTNRPPNAPLCTPCDCRMKEVQTIFGESSGDVNRALSDMKTTLNNVVGADQLRSYMQIYLPLYVAAATMELQMYKTYIDFAQKFDFDVTGTTKEHVNELRQKIKTHSEYIMNLFKNSLPEVSSNTKNQLHAYIRYTRNITLNALDMVSTWKFLDPVDYPTTATFNPTRIIFNDLAGPVECLTSNQNSNQLHFNFYDMNGQGLPNNDIFNYFYRGMQVKGLQIQTYTSSDTKSPQHFPVGFLSSYYGSNGDFQFDKRVDPSNFVGGSNSVKLGDDVYKSHPALSVINAVSNQLQVFLNYIDTEDLYFDQTVSPGGTACGSGNSTIWPDQKIQAIYPITPDNTKKYEQYFATSKIGFVTTLVPSDTTPWITFTDNGDNSIYTFSAENTRTLTGSAGPVREFITGSAPLGLSPGGGAQYSINTNDAPSGDYQVRVRVATPGSGGSLAISVDGKTQTLQLPDTNVNDTNHIAGFAGTYTLAPATQIDAATLKPKAPTENIFPVRQTSSLPVSITNNSSTVINIDRIEFVPVSVSPTTSIHRDIPTTTTQPNRTQEIWSGSKYATGLSVTGTASNDASIVFQLYDGNNVVQEIPAQGPGHGSSSMIGCYDRDGSIDKQNPTTQKYNKLVLKELSNSAYSCSRGKTGNNTYAVGIDILFSTSQSNFSSAADLEQITQQVYALFTSSSHTELASTISNYQINQVAMKVSALSDEVFGKEKALLRKLVNKAKQFMKTRNLLIGGDFETLDKWLLGTQATIADDSALFKGRYLSLQPTNGIASSYAFQKLDESKLKPYTRYKVSGFIGQSKQVELVVSRYGKEIDTILNVPYGAALPITSGPNPTCCAPEACQCPTCDGSQPDSHFFSYSIDVGKLYPDLNPGIEFGLRLAHPSGNAKVSNLEIVEERLLTEKEIKKLQRKEQKWKKAWDKERAEISAILQPVINQINAFYKNEDWSSDILPHITYQDLYNVVLPALPKLRHWFMKDREGEHYGSIQQFKQAIERVFTQLEERNLIHNGSFTNELTDWLVDGDAQITTLENGNLALQLSTWYASASQSIDISDFDEDKEYKLRVRGKGKGTITIQHGEETETMSFDKNGFYFQEQPFYFEEPSFYLQIQSEGNEFIADSVEIIEIPEEDE

SEQ ID NO: 118 - protein, 1320 aa, Artificial sequence
  variant of native sequence
MTTLSYYNVLAYPPLILDEKSPYDQYKEWQKKIDKTWKEYDEDFLPKPVMDLGKNLAEVFKGDPQAYLHLANTAIRLAFLIIPGGQTAAWGVNLVLNKVVGIFFPPQNKSLFDQIKDAVSNLVDQKLIDQEINGLMIKLNSLNQPLSRFGNSIQRAIGKPQDFETTSSNAIILDATQDCSKDSACSCSNDTNRPPNAPLCTPCDCRMKEVQTIFGESSGDVNRALSDMKTTLNNVVGADQLRSYMQIYLPLYVAAATMELQMYKTYIDFAQKFDFDVTGTTKEHVNELRQKIKTHSEYIMNLFKNSLPEVSSNTKNQLHAYIRYTRNITLNALDMVSTWKFLDPVDYPTTATFNPTRIIFNDLAGPVECLTSNQNSNQLHFNFYDMNGQGLPNNDIFNYFYRGMQVKGLQIQTYTSSDTKSPQHFPVGFLSSYYGSNGDFQFDKRVDPSNFVGGSNSVKLGDDVYKSHPALSVINAVSNQLQVFLNYIDTEDLYFDQTVSPGGTACGSGNSTIWPDQKIQAIYPITPDNTKKYEQYFATSKIGFVTTLVPSDTTPWITFTDNGDNSIYTFSAENTRTLTGSAGPVREFITGSAPLGLSPGGGAQYSINTNDAPSGDYQVRVRVATPGSGGSLAISVDGKTQTLQLPDTNVNDTNHIAGFAGTYTLAPATQIDAATLKPKAPTENIFPVRQTSSLPVSITNNSSTVINIDRIEFVPVSVSPTTSIHRDIPTTTTQPNRTQEIWSGSKYATGLSVTGTASNDASIVFQLYDGNNVVQEIPAQGPGHGSSSMIGCYDRDGSIDKQNPTTQKYNKLVLKELSNSAYSCSRGKTGNNTYAVGIDILFSTSQSNFSSAADLEQITQQVYALFTSSSHTELASTISNYQINQVAMKVSALSDEVFGKEKALLRKLVNKAKQFMKTRNLLIGGDFETLDKWLLGTQATIADDSALFKGRYLSLQPTNGIASSYAFQKLDESKLKPYTRYKVSGFIGQSKQVELVVSRYGKEIDTILNVPYGAALPITSGPNPTCCAPEACQCPTCDGSQPDSHFFSYSIDVGKLYPDLNPGIEFGLRLAHPSGNAKVSNLEIVEERLLTEKEIKKLQRKEQKWKKAWDKERAEISAILQPVINQINAFYKNEDWSSDILPHITYQDLYNVVLPALPKLRHWFMKDREGEHYGSIQQFKQAIERVFTQLEERNLIHNGSFTNELTDWLVDGDAQITTLENGNLALQLSTWYASASQSIDISDFDEDKEYKLRVRGKGKGTITIQHGEETETMSFDKNGFYFQEQPFYFEEPSFYLQIQSEGNEFIADSVEIIEIPEEDE

SEQ ID NO: 119 - protein, 716 aa, Artificial sequence
  variant of native sequence
MTTLSYYNVLAYPPLILDEKSPYDQYKEWQKKIDKTWKEYDEDFLPKPVMDLGKNLAEVFKGDPQAYLHLANTAIRLAFLIIPGGQTAAWGVNLVLNKVVGIFFPPQNKSLFDQIKDAVSNLVDQKLIDQEINGLMIKLNSLNQPLSRFGNSIQRAIGKPQDFETTSSNAIILDATQDCSKDSACSCSNDTNRPPNAPLCTPCDCRMKEVQTIFGESSGDVNRALSDMKTTLNNVVGADQLRSYMQIYLPLYVAAATMELQMYKTYIDFAQKFDFDVTGTTKEHVNELRQKIKTHSEYIMNLFKNSLPEVSSNTKNQLHAYIRYTRNITLNALDMVSTWKFLDPVDYPTTATFNPTRIIFNDLAGPVECLTSNQNSNQLHFNFYDMNGQGLPNNDIFNYFYRGMQVKGLQIQTYTSSDTKSPQHFPVGFLSSYYGSNGDFQFDKRVDPSNFVGGSNSVKLGDDVYKSHPALSVINAVSNQLQVFLNYIDTEDLYFDQTVSPGGTACGSGNSTIWPDQKIQAIYPITPDNTKKYEQYFATSKIGFVTTLVPSDTTPWITFTDNGDNSIYTFSAENTRTLTGSAGPVREFITGSAPLGLSPGGGAQYSINTNDAPSGDYQVRVRVATPGSGGSLAISVDGKTQTLQLPDTNVNDTNHIAGFAGTYTLAPATQIDAATLKPKAPTENIFPVRQTSSLPVSITNNSSTVINIDRIEFVPV

SEQ ID NO: 120 - protein, 812 aa, Unknown
  Unknown organism from environmental sample
MRAGDFMTKKQKKILSMTLATGVFAGTYIPTAYTAFAENEQKENQSKNISQNNLQIEPYGWFENPYKGVTFSQFIDAFNNNQWKPLLVNIKNKGDAGAGTISFLKGMLTTGISLLPPPASLLGSMWSVFMPTNDANGTDMWRQLETYIDEKIDSKINDYHKYLMGAEFNGAMSAIQEYQRVLQIYNDSKNSLKRVEEPGTPVIEAVRAADRKLKEFIAVIQTPEKSTDSVYQQITAPIFVQAANAHLLLQRDMILYGEEWGMDKNQWQGYKDNQKKLIQDYTNYAMKVYNEGLEKRKKEAEEINTQQPNRNTDRWNHINDYVREYTLSVLDFVALFPATNPETYSKGAMQENSRQIYSSIKGAVISQGGTGEGTTWENIQKTLDSQEYKGDLHKLDIRSYDRIDAIQPWYSDKLNGGSNWTTPGWTGNTTGGTLKPPLINSLDNPITRVKAQSSRTPNYIDFKFDSGGDNPSFGTYRSAVGYKEDVFEYPNQKLSQIHAFNRSTYPGFEGIDAVVFGFVDKNLNQSSTYLMTNMITTIPAAKYNRGMSNFQPQVESIHAKQKAMKTSTTNSYLAYNVEVSKEQEYKIRYKVAANENSKISLSHRKPGGNYAKLADTTIPITGNAADTVKGEYGSYKIVEGPTIKLTKGAHDLKLENSQGKFSLDQIELEPVEQDQVIVQDNFDNQRLNWINLGGIVNGGITGNAGMIGTNGDTWTYIQDKVLPFSKYTLSIKVKLDSNDGNERQKVTVFTDNLKHERITKTVELKGKAGYQEIQLDFITSRDLANTHVGILTSNGTSNVLFDDVQVIGAKKS

SEQ ID NO: 121 - protein, 806 aa, Artificial sequence
  variant of native sequence
MTKKQKKILSMTLATGVFAGTYIPTAYTAFAENEQKENQSKNISQNNLQIEPYGWFENPYKGVTFSQFIDAFNNNQWKPLLVNIKNKGDAGAGTISFLKGMLTTGISLLPPPASLLGSMWSVFMPTNDANGTDMWRQLETYIDEKIDSKINDYHKYLMGAEFNGAMSAIQEYQRVLQIYNDSKNSLKRVEEPGTPVIEAVRAADRKLKEFIAVIQTPEKSTDSVYQQITAPIFVQAANAHLLLQRDMILYGEEWGMDKNQWQGYKDNQKKLIQDYTNYAMKVYNEGLEKRKKEAEEINTQQPNRNTDRWNHINDYVREYTLSVLDFVALFPATNPETYSKGAMQENSRQIYSSIKGAVISQGGTGEGTTWENIQKTLDSQEYKGDLHKLDIRSYDRIDAIQPWYSDKLNGGSNWTTPGWTGNTTGGTLKPPLINSLDNPITRVKAQSSRTPNYIDFKFDSGGDNPSFGTYRSAVGYKEDVFEYPNQKLSQIHAFNRSTYPGFEGIDAVVFGFVDKNLNQSSTYLMTNMITTIPAAKYNRGMSNFQPQVESIHAKQKAMKTSTTNSYLAYNVEVSKEQEYKIRYKVAANENSKISLSHRKPGGNYAKLADTTIPITGNAADTVKGEYGSYKIVEGPTIKLTKGAHDLKLENSQGKFSLDQIELEPVEQDQVIVQDNFDNQRLNWINLGGIVNGGITGNAGMIGTNGDTWTYIQDKVLPFSKYTLSIKVKLDSNDGNERQKVTVFTDNLKHERITKTVELKGKAGYQEIQLDFITSRDLANTHVGILTSNGTSNVLFDDVQVIGAKKS

SEQ ID NO: 122 - protein, 636 aa, Artificial sequence
  variant of native sequence
MAENEQKENQSKNISQNNLQIEPYGWFENPYKGVTFSQFIDAFNNNQWKPLLVNIKNKGDAGAGTISFLKGMLTTGISLLPPPASLLGSMWSVFMPTNDANGTDMWRQLETYIDEKIDSKINDYHKYLMGAEFNGAMSAIQEYQRVLQIYNDSKNSLKRVEEPGTPVIEAVRAADRKLKEFIAVIQTPEKSTDSVYQQITAPIFVQAANAHLLLQRDMILYGEEWGMDKNQWQGYKDNQKKLIQDYTNYAMKVYNEGLEKRKKEAEEINTQQPNRNTDRWNHINDYVREYTLSVLDFVALFPATNPETYSKGAMQENSRQIYSSIKGAVISQGGTGEGTTWENIQKTLDSQEYKGDLHKLDIRSYDRIDAIQPWYSDKLNGGSNWTTPGWTGNTTGGTLKPPLINSLDNPITRVKAQSSRTPNYIDFKFDSGGDNPSFGTYRSAVGYKEDVFEYPNQKLSQIHAFNRSTYPGFEGIDAVVFGFVDKNLNQSSTYLMTNMITTIPAAKYNRGMSNFQPQVESIHAKQKAMKTSTTNSYLAYNVEVSKEQEYKIRYKVAANENSKISLSHRKPGGNYAKLADTTIPITGNAADTVKGEYGSYKIVEGPTIKLTKGAHDLKLENSQGKFSLDQIELEPV

SEQ ID NO: 123 - protein, 777 aa, Artificial sequence
  variant of native sequence
MAENEQKENQSKNISQNNLQIEPYGWFENPYKGVTFSQFIDAFNNNQWKPLLVNIKNKGDAGAGTISFLKGMLTTGISLLPPPASLLGSMWSVFMPTNDANGTDMWRQLETYIDEKIDSKINDYHKYLMGAEFNGAMSAIQEYQRVLQIYNDSKNSLKRVEEPGTPVIEAVRAADRKLKEFIAVIQTPEKSTDSVYQQITAPIFVQAANAHLLLQRDMILYGEEWGMDKNQWQGYKDNQKKLIQDYTNYAMKVYNEGLEKRKKEAEEINTQQPNRNTDRWNHINDYVREYTLSVLDFVALFPATNPETYSKGAMQENSRQIYSSIKGAVISQGGTGEGTTWENIQKTLDSQEYKGDLHKLDIRSYDRIDAIQPWYSDKLNGGSNWTTPGWTGNTTGGTLKPPLINSLDNPITRVKAQSSRTPNYIDFKFDSGGDNPSFGTYRSAVGYKEDVFEYPNQKLSQIHAFNRSTYPGFEGIDAVVFGFVDKNLNQSSTYLMTNMITTIPAAKYNRGMSNFQPQVESIHAKQKAMKTSTTNSYLAYNVEVSKEQEYKIRYKVAANENSKISLSHRKPGGNYAKLADTTIPITGNAADTVKGEYGSYKIVEGPTIKLTKGAHDLKLENSQGKFSLDQIELEPVEQDQVIVQDNFDNQRLNWINLGGIVNGGITGNAGMIGTNGDTWTYIQDKVLPFSKYTLSIKVKLDSNDGNERQKVTVFTDNLKHERITKTVELKGKAGYQEIQLDFITSRDLANTHVGILTSNGTSNVLFDDVQVIGAKKS

SEQ ID NO: 124 - protein, 665 aa, Artificial sequence
  variant of native sequence
MTKKQKKILSMTLATGVFAGTYIPTAYTAFAENEQKENQSKNISQNNLQIEPYGWFENPYKGVTFSQFIDAFNNNQWKPLLVNIKNKGDAGAGTISFLKGMLTTGISLLPPPASLLGSMWSVFMPTNDANGTDMWRQLETYIDEKIDSKINDYHKYLMGAEFNGAMSAIQEYQRVLQIYNDSKNSLKRVEEPGTPVIEAVRAADRKLKEFIAVIQTPEKSTDSVYQQITAPIFVQAANAHLLLQRDMILYGEEWGMDKNQWQGYKDNQKKLIQDYTNYAMKVYNEGLEKRKKEAEEINTQQPNRNTDRWNHINDYVREYTLSVLDFVALFPATNPETYSKGAMQENSRQIYSSIKGAVISQGGTGEGTTWENIQKTLDSQEYKGDLHKLDIRSYDRIDAIQPWYSDKLNGGSNWTTPGWTGNTTGGTLKPPLINSLDNPITRVKAQSSRTPNYIDFKFDSGGDNPSFGTYRSAVGYKEDVFEYPNQKLSQIHAFNRSTYPGFEGIDAVVFGFVDKNLNQSSTYLMTNMITTIPAAKYNRGMSNFQPQVESIHAKQKAMKTSTTNSYLAYNVEVSKEQEYKIRYKVAANENSKISLSHRKPGGNYAKLADTTIPITGNAADTVKGEYGSYKIVEGPTIKLTKGAHDLKLENSQGKFSLDQIELEPV

SEQ ID NO: 125 - protein, 671 aa, Artificial sequence
  variant of native sequence
MRAGDFMTKKQKKILSMTLATGVFAGTYIPTAYTAFAENEQKENQSKNISQNNLQIEPYGWFENPYKGVTFSQFIDAFNNNQWKPLLVNIKNKGDAGAGTISFLKGMLTTGISLLPPPASLLGSMWSVFMPTNDANGTDMWRQLETYIDEKIDSKINDYHKYLMGAEFNGAMSAIQEYQRVLQIYNDSKNSLKRVEEPGTPVIEAVRAADRKLKEFIAVIQTPEKSTDSVYQQITAPIFVQAANAHLLLQRDMILYGEEWGMDKNQWQGYKDNQKKLIQDYTNYAMKVYNEGLEKRKKEAEEINTQQPNRNTDRWNHINDYVREYTLSVLDFVALFPATNPETYSKGAMQENSRQIYSSIKGAVISQGGTGEGTTWENIQKTLDSQEYKGDLHKLDIRSYDRIDAIQPWYSDKLNGGSNWTTPGWTGNTTGGTLKPPLINSLDNPITRVKAQSSRTPNYIDFKFDSGGDNPSFGTYRSAVGYKEDVFEYPNQKLSQIHAFNRSTYPGFEGIDAVVFGFVDKNLNQSSTYLMTNMITTIPAAKYNRGMSNFQPQVESIHAKQKAMKTSTTNSYLAYNVEVSKEQEYKIRYKVAANENSKISLSHRKPGGNYAKLADTTIPITGNAADTVKGEYGSYKIVEGPTIKLTKGAHDLKLENSQGKFSLDQIELEPV

SEQ ID NO: 126 - protein, 484 aa, Bacillus sp.
MKPYQEHDEQNYTENKINENCGCNSSVQNKSFKENEEWNNSYSFQGHKGNEKDWNGQRERRYYDCNPIRSQSPNLPDESKRFQAIMLNNNIHTCVTESNHPLGEIAPLQPRECRQIITDYQTLVGSLELGTDIYFYIFYQTDGDGYVIANRENGRVLEYMDNASELFRVLTSRLYTGGANQIFNMNRATNNDFRLLTQTQPSGARYVLRPCNDSNQSLLSLVFTPASSGLGNPNTLLRFRESERIPPVPIPSLPSPTRLDPVPDLLNLNDEGTPPRYAPRATIGSALIPCIFVNDVIPLDQRIKQSPYYVLEYRQYWHQLWSYIIPSGGLREPEEITGIRPEAQEDMRDSLDIVIGADWNLRFGDKSHAFRQQISHGLNTLISRTPDNLGLRREETKYYNVHPQQVRFAKYAKAHEYRLTRPNGTEVSSPWVALDYNTMLLKSYPNNLEIVMQNSKIINSSNSYDLSVWKTPLMIRDGKIITRK

SEQ ID NO: 127 - protein, 302 aa, Unknown
  Unknown organism from environmental sample
MLATMGTSLVITYPNSVSADQINPIKSTTQTQQKPSISNWSEPIQQIYKARKQNSPNTHISKEARISGFNIIQSSVEADGPTFTNKKTMYIGRAILNNPSNKERTLSTAEFSKTIENSVTNSTTNGFNLGVSTSASFGIPLIGQTSVELSTEYNFSNTAAKTKTESYTYTAPKQEIVVPAYSSVEVIVQLDMVKVSGNVKLLSHVDGSVYWQYDKNKPNNLRGFPLKHFVRDSGTNVPSNIKAHPQNGAYLIGTGNYSAEYGTEFTVTVKDTSPIRPGSIRPTRGTNDEYTYKVKPQVKKVK

SEQ ID NO: 128 - protein, 284 aa, Artificial sequence
  variant of native sequence
MDQINPIKSTTQTQQKPSISNWSEPIQQIYKARKQNSPNTHISKEARISGFNIIQSSVEADGPTFTNKKTMYIGRAILNNPSNKERTLSTAEFSKTIENSVTNSTTNGFNLGVSTSASFGIPLIGQTSVELSTEYNFSNTAAKTKTESYTYTAPKQEIVVPAYSSVEVIVQLDMVKVSGNVKLLSHVDGSVYWQYDKNKPNNLRGFPLKHFVRDSGTNVPSNIKAHPQNGAYLIGTGNYSAEYGTEFTVTVKDTSPIRPGSIRPTRGTNDEYTYKVKPQVKKVK

SEQ ID NO: 129 - protein, 1302 aa, Unknown
  Unknown organism from environmental sample
LRNLIDVPVFLDQVIKKIRGGLYMNINDNKNEYEILDSGNLSYQPRYPLARAPGSECQKPNAKDGIYTPVGRVDTALQNIDIGLSIRTALSILQMLLSVSFPALGRAAGLINIIFGFLWGTLAGQSVWEKFMRAVESLVNQKITDAVRVKALSELEGVQNALELYQEAADDWNENPTDASNKERVRRQFTSTNTTIEYAMPSFRVPTFEVPLLTVYAQAANLHLQLLRDAVKFGNEWGMPSEEVEDMYNRLTRRTAEYTDHCVATYDKGLKEAYDLAPNPTDYNKYPYLNPYSKDPIYGKYYTAPVDWNLFNDYRRDMTLMVLDIVAVWPTYNPRIYTNPNGVQVELSREVYSTVYGRGGSNNSSFDAIESQIVRPPHLVTELTNLKIEQGATLDMEQIQYPKYMKVTNTLHYVGSSSTWEQSSSAIPIRPITQIHTIPANNIGNLSLSQLDVPYRFSFYNKDDALIAAVGAEFPPNTVTWNGIPKAEDSNQNSHHLSYVGALGTQSSAGFPWTYPTELLGEWGFGWLHNSLTPTNRLDPDKSTQLPAVKAYWYYASSGVPVIKGPGSTGGDLVLLTFYQEIALSITSNISRSYRLRFRYASTSDIRIVVYWRLENTGVVYGHNVNLPATYSGGSLTYNTFSVFDTGLIIQNAHWFTFNIRNDSGGTLILDKLEFIPIEEPLEVYQAKQDLEKAKKAVNTLFTSDAKNVLKVNVTDYEVDQVANLVECVSDESHAQEKMILLDQVKFAKRLSQARNLLNYGDFESSDWSGENGWRTSHHVSVRSDNPTFKGHYLHMPGAMSPQFSNNIYPTYAYQKVDESKLKSYTRYLVRGFVGNSKDLELLVERYGKDVHVEMDVPNDIRYTLPMNECGGFDRCKPASHQTGSPHTYTCKDTAVAHTDCQCKDKENRTSTNMYTNVPTDSAVYMNGSHTHQSCGCKNKNSDRYQSGTHPQKSCGCKDPHVFSYHIDTGCVDQEENLGLWFALKIASENGVANIDNLEIIEAQPLTGEALARVKKREQKWKQEMAQKRFQTDKAVQAAQTAMQALFTNAQYNRLKFETLFPQIVNAEMLVQQIPYMYHPFLSGALPTVPGMNFEIIQRLLAVTGNARGLYEQRNLVRNGTFSSGTGSWHVTEGVEVQPLQNTSVLVLSEWSHEASQQVRIDPDRGYVLRVTARKEGAGKGTVTMSDCADYTETLTFTSCDYNTVGTQTMTGGTLSGFVTKTLEIFPETDRIRIDIGETEGTFKIESVELICMEQMEDHLYDMAGNLEEEMLDLQSARSGSGTKLIPPLTFSDCYTNNEYCY

SEQ ID NO: 130 - protein, 1279 aa, Artificial sequence
  variant of native sequence
MNINDNKNEYEILDSGNLSYQPRYPLARAPGSECQKPNAKDGIYTPVGRVDTALQNIDIGLSIRTALSILQMLLSVSFPALGRAAGLINIIFGFLWGTLAGQSVWEKFMRAVESLVNQKITDAVRVKALSELEGVQNALELYQEAADDWNENPTDASNKERVRRQFTSTNTTIEYAMPSFRVPTFEVPLLTVYAQAANLHLQLLRDAVKFGNEWGMPSEEVEDMYNRLTRRTAEYTDHCVATYDKGLKEAYDLAPNPTDYNKYPYLNPYSKDPIYGKYYTAPVDWNLFNDYRRDMTLMVLDIVAVWPTYNPRIYTNPNGVQVELSREVYSTVYGRGGSNNSSFDAIESQIVRPPHLVTELTNLKIEQGATLDMEQIQYPKYMKVTNTLHYVGSSSTWEQSSSAIPIRPITQIHTIPANNIGNLSLSQLDVPYRFSFYNKDDALIAAVGAEFPPNTVTWNGIPKAEDSNQNSHHLSYVGALGTQSSAGFPWTYPTELLGEWGFGWLHNSLTPTNRLDPDKSTQLPAVKAYWYYASSGVPVIKGPGSTGGDLVLLTFYQEIALSITSNISRSYRLRFRYASTSDIRIVVYWRLENTGVVYGHNVNLPATYSGGSLTYNTFSVFDTGLIIQNAHWFTFNIRNDSGGTLILDKLEFIPIEEPLEVYQAKQDLEKAKKAVNTLFTSDAKNVLKVNVTDYEVDQVANLVECVSDESHAQEKMILLDQVKFAKRLSQARNLLNYGDFESSDWSGENGWRTSHHVSVRSDNPTFKGHYLHMPGAMSPQFSNNIYPTYAYQKVDESKLKSYTRYLVRGFVGNSKDLELLVERYGKDVHVEMDVPNDIRYTLPMNECGGFDRCKPASHQTGSPHTYTCKDTAVAHTDCQCKDKENRTSTNMYTNVPTDSAVYMNGSHTHQSCGCKNKNSDRYQSGTHPQKSCGCKDPHVFSYHIDTGCVDQEENLGLWFALKIASENGVANIDNLEIIEAQPLTGEALARVKKREQKWKQEMAQKRFQTDKAVQAAQTAMQALFTNAQYNRLKFETLFPQIVNAEMLVQQIPYMYHPFLSGALPTVPGMNFEIIQRLLAVTGNARGLYEQRNLVRNGTFSSGTGSWHVTEGVEVQPLQNTSVLVLSEWSHEASQQVRIDPDRGYVLRVTARKEGAGKGTVTMSDCADYTETLTFTSCDYNTVGTQTMTGGTLSGFVTKTLEIFPETDRIRIDIGETEGTFKIESVELICMEQMEDHLYDMAGNLEEEMLDLQSARSGSGTKLIPPLTFSDCYTNNEYCY

SEQ ID NO: 131 - protein, 655 aa, Artificial sequence
  variant of native sequence
MNINDNKNEYEILDSGNLSYQPRYPLARAPGSECQKPNAKDGIYTPVGRVDTALQNIDIGLSIRTALSILQMLLSVSFPALGRAAGLINIIFGFLWGTLAGQSVWEKFMRAVESLVNQKITDAVRVKALSELEGVQNALELYQEAADDWNENPTDASNKERVRRQFTSTNTTIEYAMPSFRVPTFEVPLLTVYAQAANLHLQLLRDAVKFGNEWGMPSEEVEDMYNRLTRRTAEYTDHCVATYDKGLKEAYDLAPNPTDYNKYPYLNPYSKDPIYGKYYTAPVDWNLFNDYRRDMTLMVLDIVAVWPTYNPRIYTNPNGVQVELSREVYSTVYGRGGSNNSSFDAIESQIVRPPHLVTELTNLKIEQGATLDMEQIQYPKYMKVTNTLHYVGSSSTWEQSSSAIPIRPITQIHTIPANNIGNLSLSQLDVPYRFSFYNKDDALIAAVGAEFPPNTVTWNGIPKAEDSNQNSHHLSYVGALGTQSSAGFPWTYPTELLGEWGFGWLHNSLTPTNRLDPDKSTQLPAVKAYWYYASSGVPVIKGPGSTGGDLVLLTFYQEIALSITSNISRSYRLRFRYASTSDIRIVVYWRLENTGVVYGHNVNLPATYSGGSLTYNTFSVFDTGLIIQNAHWFTFNIRNDSGGTLILDKLEFIPI

SEQ ID NO: 132 - protein, 303 aa, Bacillus sp.
MAELDLAKILQPISLRGLHNLIGCDMELYRRWNFDTEFYPMPVSPKITPSCGMDMPYEGKDCSLQGLKLHGVGVEIDPLDLIANSVPWFISVGTFQNASDLTQTFQTTEFTEKITDTTTVTKTKTLKVGNTTSTKTTLDVFLIDAEVSTSITVEGTWSTAETQTHTVEKTLRVPPMSVIVPPRKGMRVKAEYFKGELNSKDIKINAQLSGKYKINNGHHWYDQDLYPIIKSLQLGSPNIWKGIEGNGIKLNDATQTVTCYGLGTLNANFTTSTYNVLYEEFNLSTGRVEKVTKVAVYPHFPKN

SEQ ID NO: 133 - protein, 1054 aa, Bacillus sp.
MPISKEPILYPLVSSTSNIPTSESFTFDWNWGLHQALSIGTGLMKFIPGLGVVAGPYGALLNYVYGGVIDELFPKKDAEGQDTVDPTVLFQTFMAAAEQMINEKLNDTVKSTAVTKLAGLKNNLTDLKTKLDTLKDNSDPKDTDELKKQVRDKFEAVHGLFRSDMPQFRVAGYESILLPVYAQAANLHLIFLREAIIKGASEWGFPQVTIDKFYDNPTDHNGFKQLMEEYTTNCMSAYQQGLDKLATQSIDLCASDQSYWNPAYYNQYVFLDDLYSYATCQHSLGDMSYGCGGGKLKPICKNYNSRIYSKYMQSIANWNQYNEYVMSMQVTALDLVAMWPYWDPKVYPNGAKKELTREIYTDILGSPDGQTKGVTTISQELLPQPRLFTQLTQLDLNTESHTIEQDTFNPVSGKVNASYKYLDGEIIVGITQHLQTTLGDSKLHAQGSGGSKTKSYDNSHTNDFTMPLKVASWFEPRTIGFAKSSGEIYPVGTIGDETPFVEISKSIGHNSGTITAIAHHAVKISESTQSGYYEEYQGDTAYSIDEHRLSWMNYTPTSASSFVVTGKQIGSLTLGWTSSTVDPTNKVQKGTTTSIPAVKSHSITDWGTGTVVKGPGHTGGDLVKLPPNTRAKMIVTIEDTSTSYDVRIRYAAPSGGHIQFSYWNGGSDVKVADTQLQNTGGNTNFEHFQYAMLTTDNAKFKAPFSPVEILIENIGDSDVYLDKVEFLVLSQLPPETTPLTSQYMNPYGYNILWQSKNGEAANQGMVTFSQNDSAIKTFYLYNTEVVHQTTGSPSSWNGKFDTLYVQSPTSINLTQGFIVIDTTKNNPEPPIALPNQDILRPFTNEHEIWNGRYSTKALNLSLLTSSGAEGKIRFYNNTNLVHESPALSGSPSEPYTWEGSFNRITVYQSNSSDSNYFNLFGGFLKLDPNSNDNGNNGGPHNNCENIAHPDQPIYYESNNLIWTAAPNKLAYSTTEMQFVLSGGLGFTPEDIGAKVKLNFWKNDSIQYVAYGAVANLDFISAPAQSIPGGFDKITMDDVDSFSTSFRMTLGSVCY

SEQ ID NO: 134 - protein, 729 aa, Artificial sequence
  variant of native sequence
MPISKEPILYPLVSSTSNIPTSESFTFDWNWGLHQALSIGTGLMKFIPGLGVVAGPYGALLNYVYGGVIDELFPKKDAEGQDTVDPTVLFQTFMAAAEQMINEKLNDTVKSTAVTKLAGLKNNLTDLKTKLDTLKDNSDPKDTDELKKQVRDKFEAVHGLFRSDMPQFRVAGYESILLPVYAQAANLHLIFLREAIIKGASEWGFPQVTIDKFYDNPTDHNGFKQLMEEYTTNCMSAYQQGLDKLATQSIDLCASDQSYWNPAYYNQYVFLDDLYSYATCQHSLGDMSYGCGGGKLKPICKNYNSRIYSKYMQSIANWNQYNEYVMSMQVTALDLVAMWPYWDPKVYPNGAKKELTREIYTDILGSPDGQTKGVTTISQELLPQPRLFTQLTQLDLNTESHTIEQDTFNPVSGKVNASYKYLDGEIIVGITQHLQTTLGDSKLHAQGSGGSKTKSYDNSHTNDFTMPLKVASWFEPRTIGFAKSSGEIYPVGTIGDETPFVEISKSIGHNSGTITAIAHHAVKISESTQSGYYEEYQGDTAYSIDEHRLSWMNYTPTSASSFVVTGKQIGSLTLGWTSSTVDPTNKVQKGTTTSIPAVKSHSITDWGTGTVVKGPGHTGGDLVKLPPNTRAKMIVTIEDTSTSYDVRIRYAAPSGGHIQFSYWNGGSDVKVADTQLQNTGGNTNFEHFQYAMLTTDNAKFKAPFSPVEILIENIGDSDVYLDKVEFLVL

SEQ ID NO: 135 - protein, 522 aa, Bacillus sp.
MLLTQKGGHVMAISRIINPIFTKQEHLNQLSTLVNNLFSSGSSSLSQGVSDYWIDQVLLKVNALSDTVFPTQKEQLRQRLAQAKQISKARNLLVGGNFETLNKWKLSRNAFLVAGHELFQGYHLELPPAIDSVKYPSYAYQKIDESKLKTNTRYYVSAFIAQGSQLEIMVSRYGQEYSQILYVPAEMAKPISPDGGPNCCSPHPCNCAACNEEEVDSHFFQVPIDVGNLQSSQNLGIEIGFKVASTDGFAKLSNIEVFEGRPLTTAEQRKASRLENEWKEEQQTKETERTQLLQQIQQRFNMLYTTPEHHTLRTETSYQHLLETMLPSLHHVYHWFMPDVPDSDYALYYELQQKLERGWDQYFSRNLLENGDFLEPLDDSWYTQGNVSLHTINNNTMLRLHHWDSLIRKNVSLPVVNEDAEYVIRVIGKGTGSVLIQNGTTTNKLVFTNSRQMETKEFHLQPEKEQLSLTIRSDANEFLVDAIEVILITDGAEEEEQLPGMFPPINSSMGSTPNSNMMNNNQ

SEQ ID NO: 136 - protein, 924 aa, Bacillus sp.
MIFVIPKKNEFYKMTAKHSGKVAEVYAGYTSDNTNIEQWSWLGGNNQQWMFVPLDNNYYAVVNKNSGKVMEVYGGYTSDNTNIEQWSWLGGNNQQWFLHDLGSGYNKIQVKHSGKVMEVYAGYTENNRNIEQWSWNGGNNQQWQISTTGNFTLPSIQTYPVPLPPAYDNIDEILPPTTPSVVTQYTLAPGIAVADPYYNDQQKMQTGNEYYRYVREQYWEKIFSQTLAPGETFTYSQTTGMTQTDQQTVTNTVSHSIGADVGFQFMGVSAGLSYQYTQELSVTKSSTTTELTETTQTYEIRNPHNQTAAYSKYLLVSKYYVLRADGTMVGEDWTVKDINETRTVSFPPNLLPTERELNPGFVSAQQAVYDLFADAQYSTLKIETTDYMIDQAALQLEQVSDEIDALEKMMLFNLVRCAKQLSTKRNLLHYGDFESPNWRNPEDGWQASSNVTVLSDNPIFKGNYANMPGANARNGSVTPTYLYQKVGESKLKPYTRYLVRGFVGSSKELELFVTRYGKEVRDNMNIPTSPMNICNQTDGMGYGSHYTMSSDPCQYVYPTNPKGLCEDKQHFVFHIDVGEIYPRTDLGIGVGFKISSPSGMAQLSNIEVIEANPLTGEALARVKKREQKWKREMEQKCAQTERAVSLATQAVDHLFTDTQKNRLRATTTMQDIRNVEAKVKAIPYVYNLYFEEIPGMNYAISQALQSDVYTASSLYSIRNIIRNGDFSSGLSNWHTTAGADVQERDGNPHVLVISQWDTNVSQEVCVQPEHGYVLRVTARKEGSGKGYVTLTDCTAENTETVTFKSDERVATSMPPVRPERPVEPGICDMTRYSESFGIVPEMSPMRNEQPANYGTESCSCGCGCASTTYQTQAYEPQPSMNRPSSAYITKTIEIFPETNRLRIEIGETEGTFLVESIELICMED

SEQ ID NO: 137 - protein, 403 aa, Bacillus sp.
MKSISKKVMAGLLVGATSLSIWAPTSDAASLEKNRYYSVHLKKDFFLTWDVYRSKDYDNAGILLYKTNGQDNQQFVFFPLDGGSYAIVNKNSGKPVGIGDPIANDDGVRRMTLFDNDGLLQKSWTGASAEQWYLRDQGNNNYEFVNQGYGKVASYAWTGTLAQNWTYVDLDDANPSDNNRVFTISKSALPGSGFEIPGFNLDHGTFSLQQLPATGTRPDAPNYTGGIDQQLPQTSNSVVVGASLVPCIMVKDSQASDYTKIHNSPYYTLVKEEYWDKTFSKVIQPGLSESYQYKTGVSSVDQQKMTDTLSMKIGADLGLKFGQESASLKSEISRTIQTEISTTNTEATEETRSYTATGEPGKATGYTQYQLATKYTLKRADGSIVSDPWVVKNDRITVTRKTS

SEQ ID NO: 138 - protein, 376 aa, Artificial sequence
  variant of native sequence
MASLEKNRYYSVHLKKDFFLTWDVYRSKDYDNAGILLYKTNGQDNQQFVFFPLDGGSYAIVNKNSGKPVGIGDPIANDDGVRRMTLFDNDGLLQKSWTGASAEQWYLRDQGNNNYEFVNQGYGKVASYAWTGTLAQNWTYVDLDDANPSDNNRVFTISKSALPGSGFEIPGFNLDHGTFSLQQLPATGTRPDAPNYTGGIDQQLPQTSNSVVVGASLVPCIMVKDSQASDYTKIHNSPYYTLVKEEYWDKTFSKVIQPGLSESYQYKTGVSSVDQQKMTDTLSMKIGADLGLKFGQESASLKSEISRTIQTEISTTNTEATEETRSYTATGEPGKATGYTQYQLATKYTLKRADGSIVSDPWVVKNDRITVTRKTS

SEQ ID NO: 139 - protein, 752 aa, Unknown
  Unknown organism from environmental sample
MYNIEIQIRTGGISMNHNNEYEIIDSHTLPYSSNKNSNDSRYPYTNDPNQPLQNTNYKDWLNMCQGNTQYGDNFETFASADTIAAISAGTIVSGTLLAGFGGLTAISGPIGLIGAIIISFGTLLPIFWHAGDPNQTVWTQFIKIGEKFASQELTKNEFDKAMRSLDGTKNVLDLYEDALNSWIRLKKQQSPGLPPSTALQHAADQVKHLFNIAHAHFVDDLPDFKGGDLATLYLPIFAQLANYYLNLLQQGVEFADTWIKDAYPSLMEPGSGTSDYYYKLLKESIPKYSNYCANTYREGLDNLRNQPNIRWSTFNDYRRYMTITVLDTIAQFPLYDIKRYRDSIGGIQGINYELTREIYTTEINFDRLTSTTLPAQPNLTTMEYNLTRSGRLFSFLDQLVFYTENTNSGNRLVGIINRSKPTYGQGTEYLYGQKTGSPDTKTLIPFESYKVSIITDRQFYPLTYFIINQIELYLNGSPSNIFKYSAGGSLSDDKKTNDYQFPVKKECKQITDPNCSPNYNSYSHILSHFSLYSYSYLFSFTIYHIVYTGALGWTHSSVSRNNEISDKVITIIPAVKGSYLDTNSKVIEGPGHTGGNLVYLQSLDRLEITCRTPNSTQSYYIRLRYATNGTGNIIPAIFLIIPGVISTPPQRLNNTFSGTNYNNLQYENFGYFEFPSTVTLPSNRTITCTLTREDISNSILIIDKIEFIPITSSMHQNREKQKLETVQTKINTFFTNHTKNTLNIETTNYDID

SEQ ID NO: 140 - protein, 738 aa, Artificial sequence
  variant of native sequence
MNHNNEYEIIDSHTLPYSSNKNSNDSRYPYTNDPNQPLQNTNYKDWLNMCQGNTQYGDNFETFASADTIAAISAGTIVSGTLLAGFGGLTAISGPIGLIGAIIISFGTLLPIFWHAGDPNQTVWTQFIKIGEKFASQELTKNEFDKAMRSLDGTKNVLDLYEDALNSWIRLKKQQSPGLPPSTALQHAADQVKHLFNIAHAHFVDDLPDFKGGDLATLYLPIFAQLANYYLNLLQQGVEFADTWIKDAYPSLMEPGSGTSDYYYKLLKESIPKYSNYCANTYREGLDNLRNQPNIRWSTFNDYRRYMTITVLDTIAQFPLYDIKRYRDSIGGIQGINYELTREIYTTEINFDRLTSTTLPAQPNLTTMEYNLTRSGRLFSFLDQLVFYTENTNSGNRLVGIINRSKPTYGQGTEYLYGQKTGSPDTKTLIPFESYKVSIITDRQFYPLTYFIINQIELYLNGSPSNIFKYSAGGSLSDDKKTNDYQFPVKKECKQITDPNCSPNYNSYSHILSHFSLYSYSYLFSFTIYHIVYTGALGWTHSSVSRNNEISDKVITIIPAVKGSYLDTNSKVIEGPGHTGGNLVYLQSLDRLEITCRTPNSTQSYYIRLRYATNGTGNIIPAIFLIIPGVISTPPQRLNNTFSGTNYNNLQYENFGYFEFPSTVTLPSNRTITCTLTREDISNSILIIDKIEFIPITSSMHQNREKQKLETVQTKINTFFTNHTKNTLNIETTNYDID

SEQ ID NO: 141 - protein, 696 aa, Artificial sequence
  variant of native sequence
MNHNNEYEIIDSHTLPYSSNKNSNDSRYPYTNDPNQPLQNTNYKDWLNMCQGNTQYGDNFETFASADTIAAISAGTIVSGTLLAGFGGLTAISGPIGLIGAIIISFGTLLPIFWHAGDPNQTVWTQFIKIGEKFASQELTKNEFDKAMRSLDGTKNVLDLYEDALNSWIRLKKQQSPGLPPSTALQHAADQVKHLFNIAHAHFVDDLPDFKGGDLATLYLPIFAQLANYYLNLLQQGVEFADTWIKDAYPSLMEPGSGTSDYYYKLLKESIPKYSNYCANTYREGLDNLRNQPNIRWSTFNDYRRYMTITVLDTIAQFPLYDIKRYRDSIGGIQGINYELTREIYTTEINFDRLTSTTLPAQPNLTTMEYNLTRSGRLFSFLDQLVFYTENTNSGNRLVGIINRSKPTYGQGTEYLYGQKTGSPDTKTLIPFESYKVSIITDRQFYPLTYFIINQIELYLNGSPSNIFKYSAGGSLSDDKKTNDYQFPVKKECKQITDPNCSPNYNSYSHILSHFSLYSYSYLFSFTIYHIVYTGALGWTHSSVSRNNEISDKVITIIPAVKGSYLDTNSKVIEGPGHTGGNLVYLQSLDRLEITCRTPNSTQSYYIRLRYATNGTGNIIPAIFLIIPGVISTPPQRLNNTFSGTNYNNLQYENFGYFEFPSTVTLPSNRTITCTLTREDISNSILIIDKIEFIPI

SEQ ID NO: 142 - protein, 400 aa, Bacillus sp.
MKLKVLSTVGLALSLGLTSLGSGGTAFAEKPDDSYFYQIKNKQYNDKAMFASSIMMPLMINTPTFLVPDSQVQKYIFYALDNGYYAIANKDTGNVLTNAENNGWDKTDGARPYLQMGWSNTNDISRKTFRLENEYNGSFVLRNQFDGTIVNGHAKGIVLQRDFANILYNYWEPTNKEHINGNMPQLLPNQSLPDVPKYTGYGQNLPDQTVPVVTGSTIMPAIMVTDSNWSDATKIQNSPYYRLVKKQYWKRLYSRNFTPGSSETVTTKTGMSRVDVDSMVDKTGIEIKADLGASFGGEKASKKGTASLEAKFTKELTITRSTTTTDINETTVEQVVKNPSDTKDFAWAKYALATEYSLERMDGSKVSSPWTVIDGTSTRETSWPSGQQPTVQSTKTISVN

SEQ ID NO: 143 - protein, 373 aa, Artificial sequence
  variant of native sequence
MEKPDDSYFYQIKNKQYNDKAMFASSIMMPLMINTPTFLVPDSQVQKYIFYALDNGYYAIANKDTGNVLTNAENNGWDKTDGARPYLQMGWSNTNDISRKTFRLENEYNGSFVLRNQFDGTIVNGHAKGIVLQRDFANILYNYWEPTNKEHINGNMPQLLPNQSLPDVPKYTGYGQNLPDQTVPVVTGSTIMPAIMVTDSNWSDATKIQNSPYYRLVKKQYWKRLYSRNFTPGSSETVTTKTGMSRVDVDSMVDKTGIEIKADLGASFGGEKASKKGTASLEAKFTKELTITRSTTTTDINETTVEQVVKNPSDTKDFAWAKYALATEYSLERMDGSKVSSPWTVIDGTSTRETSWPSGQQPTVQSTKTISVN

SEQ ID NO: 144 - protein, 395 aa, Unknown
  Unknown organism from environmental sample
MFYIFCYYQVAISDFKYFDYRGVGKSMAFKVGTKYMFRNKNSRKYLDISGNETGNNANVQQYEYVKDALSERFFLHPLDNNYYAMINLNSGKVIDISGNETGNNANIQQYEWLGNSPSEYWYFHREADGYYVIESKHSGKVLDISGNETGNNANVQQYEYIKDAPSERFAVEEDESVLLPSIITQPLSPVPQYETINDQLPNETDHVVTAFTIVPAISVKDPKYGGDTAKQIKENPYYMVVKRQWWKKQESYVLAPGETYKYTSKTGMKVMDQETATKTVSWSIGADMGLSFKGFSVGMSTQYSTELQTTISHTTEQLKEETWDHEIKNPFSNRMAYSRYILTTEYSVQRKDETTVSPSWTMTDKTSTHSVTYPNAEEKPLNENTKQLSKAESVN

SEQ ID NO: 145 - protein, 369 aa, Artificial sequence
  variant of native sequence)
MAFKVGTKYMFRNKNSRKYLDISGNETGNNANVQQYEYVKDALSERFFLHPLDNNYYAMINLNSGKVIDISGNETGNNANIQQYEWLGNSPSEYWYFHREADGYYVIESKHSGKVLDISGNETGNNANVQQYEYIKDAPSERFAVEEDESVLLPSIITQPLSPVPQYETINDQLPNETDHVVTAFTIVPAISVKDPKYGGDTAKQIKENPYYMVVKRQWWKKQESYVLAPGETYKYTSKTGMKVMDQETATKTVSWSIGADMGLSFKGFSVGMSTQYSTELQTTISHTTEQLKEETWDHEIKNPFSNRMAYSRYILTTEYSVQRKDETTVSPSWTMTDKTSTHSVTYPNAEEKPLNENTKQLSKAESVN

SEQ ID NO: 146 - protein, 804 aa, Unknown
  Unknown organism from environmental sample
MNTNQNRNEYEISGASSNDEHISNRYPFAKNPNVMKNTNYKDWFNECQDVAPSSIVSTIGIMFNIFRQFLAFMENPDLSLGVGILRGIIGTIGGRQVINLTINDVQRLINQALENEIRNQANQRFNSIQSNYNQYLSNKSNYINNPSPQTRNLFVTSLTLNERDLRTALDVTFSLANRELLLLPSFTQIAMLHLAVLRDAVIYSGPDLIAPTISEAPGTSSLNRPPSNSYESAILTSIRMYSNYCVRHYNEGLIRIRNRGNSSRNWLDFNEYRLEMTAIILDFVSLFSLFDTTKYPVSRNFTRSVVPQLSRVIYTDPVGAITTDGRGWFDPPTGTDRLRVNFTSIENEIPAPTTSRHLSELTISSGPLGFGINPTRTHSWQGNRNVNISAPTDVSGVISNRTRTIPARNIFRVNSRVYTLDWRLFGVYRAEFFQDAHPQVFTENPPTGTGAQSANNFRFLPGENSDIPTPQDYTHVLSRVVNATVGLTPATGNQRNSVLIFGWTHKSLTSENRYDINKITQVAAVNTRSNSGIRVISGPGFTGGDLVRMDPNGRVSYNFTPANQQALQSNVAIRLRYACQGEASLRITFGNSSSQIIPLVSTTSSINNLQYESFHSVNIPNNVSFQTVGTSMDIQNISTNSNVVLDRIELFSNIPIPSETPPIPVVPPLPSGTYQILTALNNNFVIDLNPNNNVTMWTNNVSPNQRWIFTYDQSRSAYVIRSASNQNLVLAGNVLNPFNVFATPLVPGREEHFWTLERFQNGFVIKNLRDANLVLDVAGGRVGNGTNLIVYPRHSGTGQIFNIR

SEQ ID NO: 147 - protein, 655 aa, Artificial sequence
  variant of native sequence
MNTNQNRNEYEISGASSNDEHISNRYPFAKNPNVMKNTNYKDWFNECQDVAPSSIVSTIGIMFNIFRQFLAFMENPDLSLGVGILRGIIGTIGGRQVINLTINDVQRLINQALENEIRNQANQRFNSIQSNYNQYLSNKSNYINNPSPQTRNLFVTSLTLNERDLRTALDVTFSLANRELLLLPSFTQIAMLHLAVLRDAVIYSGPDLIAPTISEAPGTSSLNRPPSNSYESAILTSIRMYSNYCVRHYNEGLIRIRNRGNSSRNWLDFNEYRLEMTAIILDFVSLFSLFDTTKYPVSRNFTRSVVPQLSRVIYTDPVGAITTDGRGWFDPPTGTDRLRVNFTSIENEIPAPTTSRHLSELTISSGPLGFGINPTRTHSWQGNRNVNISAPTDVSGVISNRTRTIPARNIFRVNSRVYTLDWRLFGVYRAEFFQDAHPQVFTENPPTGTGAQSANNFRFLPGENSDIPTPQDYTHVLSRVVNATVGLTPATGNQRNSVLIFGWTHKSLTSENRYDINKITQVAAVNTRSNSGIRVISGPGFTGGDLVRMDPNGRVSYNFTPANQQALQSNVAIRLRYACQGEASLRITFGNSSSQIIPLVSTTSSINNLQYESFHSVNIPNNVSFQTVGTSMDIQNISTNSNVVLDRIELFSNIP

SEQ ID NO: 148 - protein, 890 aa, Unknown
  Unknown organism from environmental sample
MATVSELYPVPYNVLAISPSRLSSNWDEFQDIFNGVKEAFGEFQKTGQLQKEAIKQGWNAYREGKIDYLALVKASLSIVGLIVPGGEAAVPFIGMFLDFVWPKLFGGASNDETTLLNVINDVVNQILDKRLSEQQLQTVNNVLNGFQTQMLDLNQKILSATFDATTQKPRTPSASDMINVYNEFNLEQGLIHNDLYEFILKDYEDITLPMYVMAITLKLLSYQAFIQFANQWIDTVYPDTTSGEGYTFKTNLDAAKTKMQDDIDTASQHVLTVFQDHMVPAGVNKLQHNLHNQYVNTMVLQCFDFVAMWPTLHPDVYPANTSLDLTRVLFSDIVGPDEVHDGKVTLYNIFDNDNPKGYDHGSINMEDILYLRKELEQVSIFSHEDGTYCWPYGIGLKYAGDPNTYMYSPRSFDPSHTVPSSTVQAPIILVNASTQYMKGLLDKESIDIHADSGESGGGAYCPLPGHDGVEGYGRSHNSPLANQKINAFYPVTAEHVAGDQTKLGLIATHVSFDLVPQNIIGQTDTDETISVRGFPAEKGTIDNIGSLQLVPEHINGANAVKLNFQQILAIPITSVTSGYYSIRIRYASSSDITGYFHVQTPAGDLNRGAITFPNTQNMENTIDKMYVTGANGKYTLLTVTQAIKIPSGNSTIYIQNNSNADFFLDRIEVIPITASQLPAPSSANQFTFVGPYTVLPEPVGKDFVIWQTSQTCAYTPNSTLSFTILGSGEFQALDKNNNIIARKVENQNNQTTETWNLPQNVEKIRFVANDYVVLRNIIGKINCQEPIKPCTLGGQTLVDIDYNANGEQVLWSSTEPMGNCTVDIVLDSDFISSIATLQFQDNTGTVVRSIDFGPGEQNQTVSVASTTKIVLKPTTFGPISGHLKIQVVTN

SEQ ID NO: 149 - protein, 672 aa, Artificial sequence
  variant of native sequence
MATVSELYPVPYNVLAISPSRLSSNWDEFQDIFNGVKEAFGEFQKTGQLQKEAIKQGWNAYREGKIDYLALVKASLSIVGLIVPGGEAAVPFIGMFLDFVWPKLFGGASNDETTLLNVINDVVNQILDKRLSEQQLQTVNNVLNGFQTQMLDLNQKILSATFDATTQKPRTPSASDMINVYNEFNLEQGLIHNDLYEFILKDYEDITLPMYVMAITLKLLSYQAFIQFANQWIDTVYPDTTSGEGYTFKTNLDAAKTKMQDDIDTASQHVLTVFQDHMVPAGVNKLQHNLHNQYVNTMVLQCFDFVAMWPTLHPDVYPANTSLDLTRVLFSDIVGPDEVHDGKVTLYNIFDNDNPKGYDHGSINMEDILYLRKELEQVSIFSHEDGTYCWPYGIGLKYAGDPNTYMYSPRSFDPSHTVPSSTVQAPIILVNASTQYMKGLLDKESIDIHADSGESGGGAYCPLPGHDGVEGYGRSHNSPLANQKINAFYPVTAEHVAGDQTKLGLIATHVSFDLVPQNIIGQTDTDETISVRGFPAEKGTIDNIGSLQLVPEHINGANAVKLNFQQILAIPITSVTSGYYSIRIRYASSSDITGYFHVQTPAGDLNRGAITFPNTQNMENTIDKMYVTGANGKYTLLTVTQAIKIPSGNSTIYIQNNSNADFFLDRIEVIPI

SEQ ID NO: 150 - protein, 695 aa, Unknown
  Unknown organism from environmental sample
VKSMNSYQEKNESEILDASQNNSNMSNRYPRYPLANNPQDSIKHTNYKDWLAMCESNQQYDVNPAAINSSSVSTALKLVGKLLKFIEPTAGTAFTVLGSILPVLWPPETAPTPERVWNDFMTNTGSLIDLTVTDFVRRDANARMAVVKDNLNRYTTAFNNWNGNQNNPLFITAVRDQFNAANGVLRDAAIYFSNLAGYELLLLPIYTQVANFHLLLLRDGIINARYWSLARNTGAQPGDQLHVDLVKYTAQYIRHCITWYTNGLNTLRNRNVQWGTFNDYRREMIIQVLDIISLFSSYDPRLYPAYTTDTTILPKTELTREIYSALLDSPPNRPIATLEESLTRDVHLFTWLKNVDFWTSTLYPDVRFLSANRIGFSYTNSSAIQDSAIYGNSSFGTAQTHQFSLNSNVYRTSITATTAVPDQVTRMDLDLINGTSAIYNSNITPVPGGLRTSNFGFSSNESRPNQPTLQDYTHILSYIKTDIIGGHRSRVSFAWTHRTVDSNNQILTDNITQVPAVKSSVLNAQARVIKGPGHTGGDLVAITSNGTQNGRMEIQCRASNFSGTERRYRLRIRFAANSNILVNVTYTSNGIPRQTPFTTNLIPSNNEIFFPGNTIPADLRYEYFYYREPFDTILPMRVTPGELINVAIQPTNMLSNQILIIDRIEFIPITQSVLDYTEEQNLETAQEVVNNLFIN

SEQ ID NO: 151 - protein, 692 aa, Artificial sequence
  variant of native sequence
MNSYQEKNESEILDASQNNSNMSNRYPRYPLANNPQDSIKHTNYKDWLAMCESNQQYDVNPAAINSSSVSTALKLVGKLLKFIEPTAGTAFTVLGSILPVLWPPETAPTPERVWNDFMTNTGSLIDLTVTDFVRRDANARMAVVKDNLNRYTTAFNNWNGNQNNPLFITAVRDQFNAANGVLRDAAIYFSNLAGYELLLLPIYTQVANFHLLLLRDGIINARYWSLARNTGAQPGDQLHVDLVKYTAQYIRHCITWYTNGLNTLRNRNVQWGTFNDYRREMIIQVLDIISLFSSYDPRLYPAYTTDTTILPKTELTREIYSALLDSPPNRPIATLEESLTRDVHLFTWLKNVDFWTSTLYPDVRFLSANRIGFSYTNSSAIQDSAIYGNSSFGTAQTHQFSLNSNVYRTSITATTAVPDQVTRMDLDLINGTSAIYNSNITPVPGGLRTSNFGFSSNESRPNQPTLQDYTHILSYIKTDIIGGHRSRVSFAWTHRTVDSNNQILTDNITQVPAVKSSVLNAQARVIKGPGHTGGDLVAITSNGTQNGRMEIQCRASNFSGTERRYRLRIRFAANSNILVNVTYTSNGIPRQTPFTTNLIPSNNEIFFPGNTIPADLRYEYFYYREPFDTILPMRVTPGELINVAIQPTNMLSNQILIIDRIEFIPITQSVLDYTEEQNLETAQEVVNNLFIN

SEQ ID NO: 152 - protein, 666 aa, Artificial sequence
  variant of native sequence
MNSYQEKNESEILDASQNNSNMSNRYPRYPLANNPQDSIKHTNYKDWLAMCESNQQYDVNPAAINSSSVSTALKLVGKLLKFIEPTAGTAFTVLGSILPVLWPPETAPTPERVWNDFMTNTGSLIDLTVTDFVRRDANARMAVVKDNLNRYTTAFNNWNGNQNNPLFITAVRDQFNAANGVLRDAAIYFSNLAGYELLLLPIYTQVANFHLLLLRDGIINARYWSLARNTGAQPGDQLHVDLVKYTAQYIRHCITWYTNGLNTLRNRNVQWGTFNDYRREMIIQVLDIISLFSSYDPRLYPAYTTDTTILPKTELTREIYSALLDSPPNRPIATLEESLTRDVHLFTWLKNVDFWTSTLYPDVRFLSANRIGFSYTNSSAIQDSAIYGNSSFGTAQTHQFSLNSNVYRTSITATTAVPDQVTRMDLDLINGTSAIYNSNITPVPGGLRTSNFGFSSNESRPNQPTLQDYTHILSYIKTDIIGGHRSRVSFAWTHRTVDSNNQILTDNITQVPAVKSSVLNAQARVIKGPGHTGGDLVAITSNGTQNGRMEIQCRASNFSGTERRYRLRIRFAANSNILVNVTYTSNGIPRQTPFTTNLIPSNNEIFFPGNTIPADLRYEYFYYREPFDTILPMRVTPGELINVAIQPTNMLSNQILIIDRIEFIPI

SEQ ID NO: 153 - protein, 1297 aa, Unknown
  Unknown organism from environmental sample
MNGGENMNQNNQNEMQIIDSSSNDFSQSNRYPRYPLAKESNYKEWLASCDESNLDRLSTPSSVQDAVVTSLNIASYLFSFLDFGAIGTGLGILGVLFGQFWPSNNNAVWETFLRSVEELIAREIDIVERNRIMAQFDGLRNVMSNYNGALRDWNGNRDNTALQSEVRSRFDNADDAFALRIPEFRIKDFEIQSLAVYAQAATLHLLLLRDAVVNGQLWGVDPVTTQRRYEKLVCLSGAYADHCTFFYRQGLEELRGKGNWTAFNNYRRNMTIQVLDVISLFSNYDPRIYGNNTNTQLTREIFTEPLATPGWLDRYSNPDQFQQIEYNLNPSPSLSSTLLNLAADTGLGYYGAGAVTPRPIIQRTSMRRLNTGATVPFTTAWQGAPNPLISQQKQLSFEGFDVFNINSVVSREVSSQTSSLFGVQQAVFHTVIAGGNIPPTMKIIDLQPRGNYSTSVTSNIPGKRSATPTASDYTHRLSSITSTSVGTAYRDRTNIMAYGWTHVSSEKTNRILPNRITQIPFVKGIITWSGTHVRSGPDHTGGSLVSMGGDAQFGMVVTSSARQRYRVRLRYAASNSVDFRLRISPLGVDYNFTLPGGGTSFNPDLRYSSFRYITLPIEFETPNSLLNFSFDLDTLTLMNGTCFFDRVEFLPVNSIALEYEGKQKLEKAKQAVDNLFTNTGKNALKVDTTDYDVDQAANLVECVTEELYAKEKMILLDEVKHAKQLNASRNLIQNGHFAFYTDEWMTSNNVSIQADNLIFKGNYLKMPGASETEGGTTSFPTYVLQKIDESKLKPYTRYKVRGFVGSSHDVKLIVERYGKEVDALLNVRNDLALNTVAPSRIEASQCPSKTYPIIHDGCLTNVIDTNYYEEAQSGHANFKKEHGMCHQSHQFDFHIDTGEVHINKNPGIWVLFKISSPEGHATLDNIELIEEGPLVGESLALVKKREKKWKHEMGTRWLQTKEVYEKAKGEIDALFTDAQDQALKFDTNISHIISAEHLVQSMPYVYNKWISDVPGMNYDIYTELERRIMQAYSLYERRNIIKNGDFDHGLNHWHATPHAKVQQMDGTAVLVIPNWSSNVSQNLCVEHNHGYVLRVTAKKEDMGKGYVTISDCNGNQETLKFTSCDNYVSNEITNDQSEYPFSQEMNEQRSYNPNETINEQLDYSLGQVRNEQRCYTRNEITNDQSEYHSSQEMNEQRSYNPNETINEQLDYSLGQVRNEQRCYTRNEITSDQSEYHSSQEMNEQRNYNSNEAINEQRNYVTRTIDFFPDTDQVRIDIGETEGIFKVESIELICMKSQ

SEQ ID NO: 154 - protein, 646 aa, Artificial sequence
  variant of native sequence
MNQNNQNEMQIIDSSSNDFSQSNRYPRYPLAKESNYKEWLASCDESNLDRLSTPSSVQDAVVTSLNIASYLFSFLDFGAIGTGLGILGVLFGQFWPSNNNAVWETFLRSVEELIAREIDIVERNRIMAQFDGLRNVMSNYNGALRDWNGNRDNTALQSEVRSRFDNADDAFALRIPEFRIKDFEIQSLAVYAQAATLHLLLLRDAVVNGQLWGVDPVTTQRRYEKLVCLSGAYADHCTFFYRQGLEELRGKGNWTAFNNYRRNMTIQVLDVISLFSNYDPRIYGNNTNTQLTREIFTEPLATPGWLDRYSNPDQFQQIEYNLNPSPSLSSTLLNLAADTGLGYYGAGAVTPRPIIQRTSMRRLNTGATVPFTTAWQGAPNPLISQQKQLSFEGFDVFNINSVVSREVSSQTSSLFGVQQAVFHTVIAGGNIPPTMKIIDLQPRGNYSTSVTSNIPGKRSATPTASDYTHRLSSITSTSVGTAYRDRTNIMAYGWTHVSSEKTNRILPNRITQIPFVKGIITWSGTHVRSGPDHTGGSLVSMGGDAQFGMVVTSSARQRYRVRLRYAASNSVDFRLRISPLGVDYNFTLPGGGTSFNPDLRYSSFRYITLPIEFETPNSLLNFSFDLDTLTLMNGTCFFDRVEFLPV

SEQ ID NO: 155 - protein, 1291 aa, Artificial sequence
  variant of native sequence
MNQNNQNEMQIIDSSSNDFSQSNRYPRYPLAKESNYKEWLASCDESNLDRLSTPSSVQDAVVTSLNIASYLFSFLDFGAIGTGLGILGVLFGQFWPSNNNAVWETFLRSVEELIAREIDIVERNRIMAQFDGLRNVMSNYNGALRDWNGNRDNTALQSEVRSRFDNADDAFALRIPEFRIKDFEIQSLAVYAQAATLHLLLLRDAVVNGQLWGVDPVTTQRRYEKLVCLSGAYADHCTFFYRQGLEELRGKGNWTAFNNYRRNMTIQVLDVISLFSNYDPRIYGNNTNTQLTREIFTEPLATPGWLDRYSNPDQFQQIEYNLNPSPSLSSTLLNLAADTGLGYYGAGAVTPRPIIQRTSMRRLNTGATVPFTTAWQGAPNPLISQQKQLSFEGFDVFNINSVVSREVSSQTSSLFGVQQAVFHTVIAGGNIPPTMKIIDLQPRGNYSTSVTSNIPGKRSATPTASDYTHRLSSITSTSVGTAYRDRTNIMAYGWTHVSSEKTNRILPNRITQIPFVKGIITWSGTHVRSGPDHTGGSLVSMGGDAQFGMVVTSSARQRYRVRLRYAASNSVDFRLRISPLGVDYNFTLPGGGTSFNPDLRYSSFRYITLPIEFETPNSLLNFSFDLDTLTLMNGTCFFDRVEFLPVNSIALEYEGKQKLEKAKQAVDNLFTNTGKNALKVDTTDYDVDQAANLVECVTEELYAKEKMILLDEVKHAKQLNASRNLIQNGHFAFYTDEWMTSNNVSIQADNLIFKGNYLKMPGASETEGGTTSFPTYVLQKIDESKLKPYTRYKVRGFVGSSHDVKLIVERYGKEVDALLNVRNDLALNTVAPSRIEASQCPSKTYPIIHDGCLTNVIDTNYYEEAQSGHANFKKEHGMCHQSHQFDFHIDTGEVHINKNPGIWVLFKISSPEGHATLDNIELIEEGPLVGESLALVKKREKKWKHEMGTRWLQTKEVYEKAKGEIDALFTDAQDQALKFDTNISHIISAEHLVQSMPYVYNKWISDVPGMNYDIYTELERRIMQAYSLYERRNIIKNGDFDHGLNHWHATPHAKVQQMDGTAVLVIPNWSSNVSQNLCVEHNHGYVLRVTAKKEDMGKGYVTISDCNGNQETLKFTSCDNYVSNEITNDQSEYPFSQEMNEQRSYNPNETINEQLDYSLGQVRNEQRCYTRNEITNDQSEYHSSQEMNEQRSYNPNETINEQLDYSLGQVRNEQRCYTRNEITSDQSEYHSSQEMNEQRNYNSNEAINEQRNYVTRTIDFFPDTDQVRIDIGETEGIFKVESIELICMKSQ

SEQ ID NO: 156 - protein, 590 aa, Bacillus sp.
MKYKDRAHAKRKYEQALLVTVATMTLVVSTFGSTAPTFAAENTANVQQAPTVPATDEPVFKRESNGTITVLKDKLFNMETLKAIGSLGGDTLKQAWADSKVEGGNFNNTFRTLTMGSAALIPYGGVVISPLIGLLWPEDTTDAKKRLENLMKDISKQTHAQIESYDLETLGQKLDKLYKDLKEFEEIINPNGRQLAKAPSVGDEAAAIRSKAEFIHNDFKELISESQKPSYKEAELPIFMVAATAHLNFLHYMELHGKDPKINYNDTGLKLTFLDPQKQARKDYLDYATSFAKKDVDNADQFVQKSIPEYLYKISRSDQWGASLLKSAMELTIKGMSEHLENTLNNSINNIAFKQILGIQSEWTMNQNGRTLYYDLQGQMQTGWKEISTSFATKYDRGSSSYPLSHESLKKLLPYSWYYFSPEKTDKFEKGEMYRDTTQTIDGKTYQFDSDGKCLNPDGGKPTGWSHQGDVWHYLSPTDGFQNYDGQSFKKGEMVTGWITLDGQYFYLSPVDGTTNDNNDTGVNVSFKKGDMMTGWVKVKGTWYYLNDKSEYGTVGHALTGDNFGKGFNLKNKEGKINNHKFNTNGTWIH

SEQ ID NO: 157 - protein, 552 aa, Artificial sequence
  variant of native sequence
MAENTANVQQAPTVPATDEPVFKRESNGTITVLKDKLFNMETLKAIGSLGGDTLKQAWADSKVEGGNFNNTFRTLTMGSAALIPYGGVVISPLIGLLWPEDTTDAKKRLENLMKDISKQTHAQIESYDLETLGQKLDKLYKDLKEFEEIINPNGRQLAKAPSVGDEAAAIRSKAEFIHNDFKELISESQKPSYKEAELPIFMVAATAHLNFLHYMELHGKDPKINYNDTGLKLTFLDPQKQARKDYLDYATSFAKKDVDNADQFVQKSIPEYLYKISRSDQWGASLLKSAMELTIKGMSEHLENTLNNSINNIAFKQILGIQSEWTMNQNGRTLYYDLQGQMQTGWKEISTSFATKYDRGSSSYPLSHESLKKLLPYSWYYFSPEKTDKFEKGEMYRDTTQTIDGKTYQFDSDGKCLNPDGGKPTGWSHQGDVWHYLSPTDGFQNYDGQSFKKGEMVTGWITLDGQYFYLSPVDGTTNDNNDTGVNVSFKKGDMMTGWVKVKGTWYYLNDKSEYGTVGHALTGDNFGKGFNLKNKEGKINNHKFNTNGTWIH

SEQ ID NO: 158 - protein, 734 aa, Bacillus sp.
MVVLKDIYKGPYNVLAIPPLQNAAIPVSNYDELIEDLQTELFLGRSERAIASILENIADNNINYQTIVMMSLGLASFAVPALGLLTPFVGLFFSLLNPGPEPPTVEDIFKAMQPAIQDMIDRSLTQTELNQMNNHSDALQKQLGIYKDAMEHFHSLTNPTDIQVNDLHNQIDYTNNILQTGLSFFKTKDYEVLGLPYYTMFATISLLLLSDKVKHGLAWRYSSNDISFFEGQFNAATQEYSSQIVKIIQTMERKQVESIDFYQNVTGFMSTWPGISPINYKMKNNLDNTQTFKYKIYNPNPGDPPITEYKMFDRTPIAQLKSVPCTNNKTSVTAIDTINNSYSLGMVDFDTYAFYLRPSDPSDCAQTYTIDPMLPLLAEWARYNAGQPPIGRAFAFWTNPPVIPNGIVFFPYIDDLMFIGETGFGNNVIHNGMKISQITGFFNFNFVNILTVPENISNDAHSILSIPAEKYSLINGWKSVLEANLNYPNEAVTGSTPLISTAVNQDLAFNVINLLPPNGSWTQYKLRVHYATDADGAELSLINYGYNTQYYPTQSSIKLTNTVTLSNQQPSDVQENILLSYPSTKGLLGTYMISTDTIPINLGQGQCQFTLRNTGGKKIILDRIELIPILPGPIVDIIPQKFFPATPEPPVIWENTTVRAVRAELRLEPQQSLYEMVVDFLLEGVVQSTQQARIGTFLYDYVPQGFDEIIIHFRNVPWLFQLDVTVSGTLYGPN

SEQ ID NO: 159 - protein, 629 aa, Artificial sequence
  variant of native sequence
MVVLKDIYKGPYNVLAIPPLQNAAIPVSNYDELIEDLQTELFLGRSERAIASILENIADNNINYQTIVMMSLGLASFAVPALGLLTPFVGLFFSLLNPGPEPPTVEDIFKAMQPAIQDMIDRSLTQTELNQMNNHSDALQKQLGIYKDAMEHFHSLTNPTDIQVNDLHNQIDYTNNILQTGLSFFKTKDYEVLGLPYYTMFATISLLLLSDKVKHGLAWRYSSNDISFFEGQFNAATQEYSSQIVKIIQTMERKQVESIDFYQNVTGFMSTWPGISPINYKMKNNLDNTQTFKYKIYNPNPGDPPITEYKMFDRTPIAQLKSVPCTNNKTSVTAIDTINNSYSLGMVDFDTYAFYLRPSDPSDCAQTYTIDPMLPLLAEWARYNAGQPPIGRAFAFWTNPPVIPNGIVFFPYIDDLMFIGETGFGNNVIHNGMKISQITGFFNFNFVNILTVPENISNDAHSILSIPAEKYSLINGWKSVLEANLNYPNEAVTGSTPLISTAVNQDLAFNVINLLPPNGSWTQYKLRVHYATDADGAELSLINYGYNTQYYPTQSSIKLTNTVTLSNQQPSDVQENILLSYPSTKGLLGTYMISTDTIPINLGQGQCQFTLRNTGGKKIILDRIELIPI

SEQ ID NO: 160 - protein, 883 aa, Bacillus sp.
MATVSELYPVPYNVLAISPSRLSSNWDEFQEIFNGVKEAFGEFQKTGQLQKEAIQQGWNAYQGGKIDYLALVKASLSIVGLIVPGGEAAVPFIGMFLDFVWPKLFGGTSNDNTTLLNIINDAVNKILDKRLSDQQLHTVNNILNGFQAQMIDLNQKILSATFDATTQKPRTPNASDLNSVYNEFNLEQGLIHNNLYEFILEDYEDITLPMYVIAITIKLLTYQAFIQFANRWIDTVFPDTTSGEGYTFKTNLDLAKTNMQNDINEASQHVLTVFKNHMVPAGVNKLQHNLHNQYVNTMVLQCFDFVAMWPTLYPDLYPANTSLDLTRVLFSDIVGPDEAHDGNVTLYNILESPQDYKHNPINMEDIFYSRKELEQVQFATESSTNKCWPYGIGLKYAGDQSIYQYGTRDPSNNFTYTITVPTTVVNAHTQYVSATHLDMEDIFIDNAEGYSGGLHCPIPGQDGSEGFARSNNSPLSNQKINAFYPVTAERVAGDQGKLGLIAAHVPFDLVPQNIIGQRDTDETISGRGFPAEKGTINNNTGSLQIVPEHINGANAVKLNYQQILAIPIISVTNGYYSIRIRYASSSDITGYFHVQTPAGDSNRGSITFPNTQNTIDKMYVTGENGNYTLLTVAQAIKFSSGKSTIYIQNNSNADLFLDRIEVVPITASQLPAPSSANQFTLVGPYTMLPEPVGEEFVIWQTSQTCAYTPNSTLSFTILGSGEFQVLDKNNNIIARRSENQNNQTTETWNLPQNVEKIRFVANDYVVLRNIIGKINCQEPIKPCTLGGQTLVDINYNANGEQVLWSSTEPMGNCTVDIVIDSDFISSIATLQFQDNTGTVVRSIDFGPGEQNQTVSVASTTKIVLKPTTFGPISGHLKIQVVTN

SEQ ID NO: 161 - protein, 665 aa, Artificial sequence
  variant of native sequence
MATVSELYPVPYNVLAISPSRLSSNWDEFQEIFNGVKEAFGEFQKTGQLQKEAIQQGWNAYQGGKIDYLALVKASLSIVGLIVPGGEAAVPFIGMFLDFVWPKLFGGTSNDNTTLLNIINDAVNKILDKRLSDQQLHTVNNILNGFQAQMIDLNQKILSATFDATTQKPRTPNASDLNSVYNEFNLEQGLIHNNLYEFILEDYEDITLPMYVIAITIKLLTYQAFIQFANRWIDTVFPDTTSGEGYTFKTNLDLAKTNMQNDINEASQHVLTVFKNHMVPAGVNKLQHNLHNQYVNTMVLQCFDFVAMWPTLYPDLYPANTSLDLTRVLFSDIVGPDEAHDGNVTLYNILESPQDYKHNPINMEDIFYSRKELEQVQFATESSTNKCWPYGIGLKYAGDQSIYQYGTRDPSNNFTYTITVPTTVVNAHTQYVSATHLDMEDIFIDNAEGYSGGLHCPIPGQDGSEGFARSNNSPLSNQKINAFYPVTAERVAGDQGKLGLIAAHVPFDLVPQNIIGQRDTDETISGRGFPAEKGTINNNTGSLQIVPEHINGANAVKLNYQQILAIPIISVTNGYYSIRIRYASSSDITGYFHVQTPAGDSNRGSITFPNTQNTIDKMYVTGENGNYTLLTVAQAIKFSSGKSTIYIQNNSNADLFLDRIEVVPI

SEQ ID NO: 162 - protein, 687 aa, Bacillus sp.
MYSYQNKNKREILDTPKNKCEMSNHYSKYPLTNVPNQQLKNTNYKDWVSTCEGIFEQSLTFPTLMRVIGSITSKVLGLLPIPGASYLSFLVSTFWPTISGPPNTIWEDMMKYVSNLIQQELEGEIIDHVTRNLVGLNETLDIYNRALDGWKQNNHSYASAETVRQLISSLHLIFTDHIQVDFSLKKYETILLPSYASAATLHLLLLRDVAIYGEELGYKKEDLEFYYGELRYFTEKYTNYCMYTYNTGLMVEKEKGWPAFNQYRREMTMAVLDVIALFPIYDARLYPSKDSMINVKSELTREIYSDVINSDVPGIISPNFEYNDLGYTRSPHLFTWLRGLRLVRNTISNSRYNWYILSGVTNKYSYTNGFDINLGPFMGQDTDYGGASYNIEIPSGSYIYNLWTRHFDWIYPYTDPINISDIHFFVTDNYSSKEVTFGHTGSTVLPVTRTDFDFLFNKEGTAPATYNDYSHILSYISLISSGQKRHGYSFSFTHSSVDPYNTIVPDKITQIPAVKANGLYNGATVIKGPGHTGGDVLFLPGNTSEDPNFGIYMTNSISQPMSFKIRIRYASNINNVTLHMIDTFEGTQDSFFELKSTFLGNQIENLSYNNFQYTETPIIRSISGMKPNAFLRFFNTNPNAQILIDKIEFIPINLFTTQYLKQTQRYNNTYKESCDCTCNQHNNYYSK

SEQ ID NO: 163 - protein, 652 aa, Artificial sequence
  variant of native sequence
MYSYQNKNKREILDTPKNKCEMSNHYSKYPLTNVPNQQLKNTNYKDWVSTCEGIFEQSLTFPTLMRVIGSITSKVLGLLPIPGASYLSFLVSTFWPTISGPPNTIWEDMMKYVSNLIQQELEGEIIDHVTRNLVGLNETLDIYNRALDGWKQNNHSYASAETVRQLISSLHLIFTDHIQVDFSLKKYETILLPSYASAATLHLLLLRDVAIYGEELGYKKEDLEFYYGELRYFTEKYTNYCMYTYNTGLMVEKEKGWPAFNQYRREMTMAVLDVIALFPIYDARLYPSKDSMINVKSELTREIYSDVINSDVPGIISPNFEYNDLGYTRSPHLFTWLRGLRLVRNTISNSRYNWYILSGVTNKYSYTNGFDINLGPFMGQDTDYGGASYNIEIPSGSYIYNLWTRHFDWIYPYTDPINISDIHFFVTDNYSSKEVTFGHTGSTVLPVTRTDFDFLFNKEGTAPATYNDYSHILSYISLISSGQKRHGYSFSFTHSSVDPYNTIVPDKITQIPAVKANGLYNGATVIKGPGHTGGDVLFLPGNTSEDPNFGIYMTNSISQPMSFKIRIRYASNINNVTLHMIDTFEGTQDSFFELKSTFLGNQIENLSYNNFQYTETPIIRSISGMKPNAFLRFFNTNPNAQILIDKIEFIPI

SEQ ID NO: 164 - protein, 680 aa, Unknown
  Unknown organism from environmental sample
VKSMDSYQNKNEYEILDASQKNSNMSNRYPRYPHAHNPKIPMRNTNYKDWLNGCEGTTNGDCSPISPSNIGFDTLQTSMNLMITLIGALGGPVTSIIYTLGNTFINLLWGAVGNKWDSSRDMVEEIINQRLEGNLRERAAAESKGLETTFTLYLTRLQTWQRTLDPRDLEELKRQFTATDNVLMYNLDLFTQGNARPILLPSYVYAATLHLNLLRDSTIYGEQWGYSREQIECNYARLRVEIAQRSDYCARTYHEGLNNLRGSTSSQWIKFNRYRTNLTISALDLAMLFPFYDPRSYPSAVKTELTREIYTDPVGYLDWELNLSSFNTLEATGTRGPGLVTWLKKIDIFTDELLSYSGWTPVVYLRGWGGTRHYESYTSGDNFQRISGTTSNEVRSLDFLANDVFKITSLSRYALAGGGAPGSPRYRVSRAELFRNLNVYDLVYEVPSPGLGSMTIESMLPGIKNQSPNRTDYSHRLSNAACVPFGDSRINVFGWTHQGMLNRNLVYKDKITQIAAVKAWEIRGNSSVVAGPGNTGGNLVKMSNHSVWSMRIHCEQLKNYRVRIRYASDGNSQLEMRRWTAAGYVQSANHHVQRTFSGTMTYDSFKFLDVFTMVAEASYFDLTIDVFGAGALFIDKIEFIPVEIPIIKCTDCQYSTSICECKCGGVQSSEKEIVNSLFVK

SEQ ID NO: 165 - protein, 639 aa, Artificial sequence
  variant of native sequence
MDSYQNKNEYEILDASQKNSNMSNRYPRYPHAHNPKIPMRNTNYKDWLNGCEGTTNGDCSPISPSNIGFDTLQTSMNLMITLIGALGGPVTSIIYTLGNTFINLLWGAVGNKWDSSRDMVEEIINQRLEGNLRERAAAESKGLETTFTLYLTRLQTWQRTLDPRDLEELKRQFTATDNVLMYNLDLFTQGNARPILLPSYVYAATLHLNLLRDSTIYGEQWGYSREQIECNYARLRVEIAQRSDYCARTYHEGLNNLRGSTSSQWIKFNRYRTNLTISALDLAMLFPFYDPRSYPSAVKTELTREIYTDPVGYLDWELNLSSFNTLEATGTRGPGLVTWLKKIDIFTDELLSYSGWTPVVYLRGWGGTRHYESYTSGDNFQRISGTTSNEVRSLDFLANDVFKITSLSRYALAGGGAPGSPRYRVSRAELFRNLNVYDLVYEVPSPGLGSMTIESMLPGIKNQSPNRTDYSHRLSNAACVPFGDSRINVFGWTHQGMLNRNLVYKDKITQIAAVKAWEIRGNSSVVAGPGNTGGNLVKMSNHSVWSMRIHCEQLKNYRVRIRYASDGNSQLEMRRWTAAGYVQSANHHVQRTFSGTMTYDSFKFLDVFTMVAEASYFDLTIDVFGAGALFIDKIEFIPV

SEQ ID NO: 166 - protein, 677 aa, Artificial sequence
  variant of native sequence
MDSYQNKNEYEILDASQKNSNMSNRYPRYPHAHNPKIPMRNTNYKDWLNGCEGTTNGDCSPISPSNIGFDTLQTSMNLMITLIGALGGPVTSIIYTLGNTFINLLWGAVGNKWDSSRDMVEEIINQRLEGNLRERAAAESKGLETTFTLYLTRLQTWQRTLDPRDLEELKRQFTATDNVLMYNLDLFTQGNARPILLPSYVYAATLHLNLLRDSTIYGEQWGYSREQIECNYARLRVEIAQRSDYCARTYHEGLNNLRGSTSSQWIKFNRYRTNLTISALDLAMLFPFYDPRSYPSAVKTELTREIYTDPVGYLDWELNLSSFNTLEATGTRGPGLVTWLKKIDIFTDELLSYSGWTPVVYLRGWGGTRHYESYTSGDNFQRISGTTSNEVRSLDFLANDVFKITSLSRYALAGGGAPGSPRYRVSRAELFRNLNVYDLVYEVPSPGLGSMTIESMLPGIKNQSPNRTDYSHRLSNAACVPFGDSRINVFGWTHQGMLNRNLVYKDKITQIAAVKAWEIRGNSSVVAGPGNTGGNLVKMSNHSVWSMRIHCEQLKNYRVRIRYASDGNSQLEMRRWTAAGYVQSANHHVQRTFSGTMTYDSFKFLDVFTMVAEASYFDLTIDVFGAGALFIDKIEFIPVEIPIIKCTDCQYSTSICECKCGGVQSSEKEIVNSLFVK

SEQ ID NO: 167 - protein, 398 aa, Bacillus sp.
MKSISKKVMAGLLVGATSLSIWAPISEAAAPENNRYYNIKLKSNQNKVWNVSQASNDNDRAIVLWQGGSADNEKFAFFQLDGGAYAIVNKNSGKVVTFGDLSYFGDKNIIPDNDGLQQQSWNGEAKQKWNLRDLGDNNYEIMNQGNGKVASYAWQGTLADNVEYVDLDNSNPSDADRVFTLFNGTVNFLGQNITFFNDTILVPSLPATGTRPDAPNYTGGVDQQLPQTSNSVVVGASLIPCFMVNDNQASDYTKIHNSPYYTLVKEEYWDKTFSAVIPAGLTRNYSFKTGMTSVDQQKMTDTLSMKIGADLGLKFGQQSASIKTEVSRTLQTEISTTNTEASEETVTSTVASEPGKTTGYTEYQLATKYTLKRADGSIVSDPWVVKNNKITIARKNAQ

SEQ ID NO: 168 - protein, 369 aa, Artificial sequence
  variant of native sequence
MPENNRYYNIKLKSNQNKVWNVSQASNDNDRAIVLWQGGSADNEKFAFFQLDGGAYAIVNKNSGKVVTFGDLSYFGDKNIIPDNDGLQQQSWNGEAKQKWNLRDLGDNNYEIMNQGNGKVASYAWQGTLADNVEYVDLDNSNPSDADRVFTLFNGTVNFLGQNITFFNDTILVPSLPATGTRPDAPNYTGGVDQQLPQTSNSVVVGASLIPCFMVNDNQASDYTKIHNSPYYTLVKEEYWDKTFSAVIPAGLTRNYSFKTGMTSVDQQKMTDTLSMKIGADLGLKFGQQSASIKTEVSRTLQTEISTTNTEASEETVTSTVASEPGKTTGYTEYQLATKYTLKRADGSIVSDPWVVKNNKITIARKNAQ

SEQ ID NO: 169 - protein, 286 aa, Bacillus sp.
LKMAISDMRVLAEQYARWSLERDSNVVPGSPKNFNMFDSVVYDDVATPTQTNFKVTPALARTAVQTLKNGTDVPQNQTVKFSETKTLTTKTTTTEGVKNTQSTKTSTKFSTGFKIDWFNAGMDFTIEVTSTGEYSYTTSTEQSFSNSSLWEVTQPVTVPPHSTVRAVLYIYEATFNVDYDLNAKVRGTATSPIPTYYDYFNMQYTKKSGGTATRWFYASNLYNTSWPGKPSSFVGYDSDSYHPLRFKGKGTSTVATGLFTEVEFIQSPLPGYAGETKTWKTGPILV

SEQ ID NO: 170 - protein, 284 aa, Artificial sequence
  variant of native sequence
MAISDMRVLAEQYARWSLERDSNVVPGSPKNFNMFDSVVYDDVATPTQTNFKVTPALARTAVQTLKNGTDVPQNQTVKFSETKTLTTKTTTTEGVKNTQSTKTSTKFSTGFKIDWFNAGMDFTIEVTSTGEYSYTTSTEQSFSNSSLWEVTQPVTVPPHSTVRAVLYIYEATFNVDYDLNAKVRGTATSPIPTYYDYFNMQYTKKSGGTATRWFYASNLYNTSWPGKPSSFVGYDSDSYHPLRFKGKGTSTVATGLFTEVEFIQSPLPGYAGETKTWKTGPILV

SEQ ID NO: 171 - protein, 673 aa, Bacillus sp.
VGNMDSYQNKNECEVLDPSGNNVNMSNRYPYANDSNMEMRNMNYTDWMANSEEITSSSISLILSSIGIINKLITLTGVLGKTPAIINIVGEIIGLIRPNTGNDLLVRVEQLIQQTLANQYRNDATGAIYGISRAYNNYLLFFSRWERDRTFQNGQQVESAFTTVNTLCISALATQAILARRGFETLLLPNYAIAANFHLLLLRDAAIYRRQWLQINNFTENENLIILRQAIDEYINHCTRWYNDGLQRFTRTGTLNNWDAFNSYRRDMTLSVLDFATIFPTYDPGRFPVGTNVQLTRRVYTDLVHDVPVHLNRGPHFAMIEPLTHINGPADFLNELRIYTTYYHRPNNVYRDYWVGNRNTFRNGNLTSSGGTSPWPTNLNMNNIDIFRVNSTTHFINQTGARYTGVHRADFIGVNRLNNQNTTLRYNQNNSTGSFRHRNISSFLPGETTLEPNAQNYTHRLFDANTTFRSQHNERDAVYLYGWTHRSLTSGNTFKVNQITQIPAVKTTSTNNDCVIISNTGENMIKLDNLTTDIYYELTTADSEAMNTCFIVRIRYASMNNNRLKLILDGTEIASLNVESTIQSNKPLTDLQYKDFKYATFAGNFKMGSQSTLGILKETSNTEFVLDKIELIPIEIFRNQLLEERQSYTNNYDEDFGYTCNQGYNGDCNQRLH

SEQ ID NO: 172 - protein, 631 aa, Artificial sequence
  variant of native sequence
MDSYQNKNECEVLDPSGNNVNMSNRYPYANDSNMEMRNMNYTDWMANSEEITSSSISLILSSIGIINKLITLTGVLGKTPAIINIVGEIIGLIRPNTGNDLLVRVEQLIQQTLANQYRNDATGAIYGISRAYNNYLLFFSRWERDRTFQNGQQVESAFTTVNTLCISALATQAILARRGFETLLLPNYAIAANFHLLLLRDAAIYRRQWLQINNFTENENLIILRQAIDEYINHCTRWYNDGLQRFTRTGTLNNWDAFNSYRRDMTLSVLDFATIFPTYDPGRFPVGTNVQLTRRVYTDLVHDVPVHLNRGPHFAMIEPLTHINGPADFLNELRIYTTYYHRPNNVYRDYWVGNRNTFRNGNLTSSGGTSPWPTNLNMNNIDIFRVNSTTHFINQTGARYTGVHRADFIGVNRLNNQNTTLRYNQNNSTGSFRHRNISSFLPGETTLEPNAQNYTHRLFDANTTFRSQHNERDAVYLYGWTHRSLTSGNTFKVNQITQIPAVKTTSTNNDCVIISNTGENMIKLDNLTTDIYYELTTADSEAMNTCFIVRIRYASMNNNRLKLILDGTEIASLNVESTIQSNKPLTDLQYKDFKYATFAGNFKMGSQSTLGILKETSNTEFVLDKIELIPI

SEQ ID NO: 173 - protein, 670 aa, Artificial sequence
  variant of native sequence
MDSYQNKNECEVLDPSGNNVNMSNRYPYANDSNMEMRNMNYTDWMANSEEITSSSISLILSSIGIINKLITLTGVLGKTPAIINIVGEIIGLIRPNTGNDLLVRVEQLIQQTLANQYRNDATGAIYGISRAYNNYLLFFSRWERDRTFQNGQQVESAFTTVNTLCISALATQAILARRGFETLLLPNYAIAANFHLLLLRDAAIYRRQWLQINNFTENENLIILRQAIDEYINHCTRWYNDGLQRFTRTGTLNNWDAFNSYRRDMTLSVLDFATIFPTYDPGRFPVGTNVQLTRRVYTDLVHDVPVHLNRGPHFAMIEPLTHINGPADFLNELRIYTTYYHRPNNVYRDYWVGNRNTFRNGNLTSSGGTSPWPTNLNMNNIDIFRVNSTTHFINQTGARYTGVHRADFIGVNRLNNQNTTLRYNQNNSTGSFRHRNISSFLPGETTLEPNAQNYTHRLFDANTTFRSQHNERDAVYLYGWTHRSLTSGNTFKVNQITQIPAVKTTSTNNDCVIISNTGENMIKLDNLTTDIYYELTTADSEAMNTCFIVRIRYASMNNNRLKLILDGTEIASLNVESTIQSNKPLTDLQYKDFKYATFAGNFKMGSQSTLGILKETSNTEFVLDKIELIPIEIFRNQLLEERQSYTNNYDEDFGYTCNQGYNGDCNQRLH

SEQ ID NO: 174 - protein, 684 aa, Unknown
  Unknown organism from environmental sample
MNQNNNNEYEIIDSKNLPCPSNRNIDYSRYPFTNNPNQPLQNTNYKDWINMYQKNQQYGENLETFASADTIAAVSAGVIVVGTMLGAFAAPVTAGLIISFGTLLPIFWKPSEDPKTVWKAFLTIGNRPFGSPVDQAIIDLLYTKVNGLRLQFEDFQRYFDIWKNNKTPGNAGEVLRRFSSLDADVIRELEQLKGTYYITLLPGYTQVANWHLNLLRQAAYYYDEWAPSSNLLIQSIYPQDYTSDLQTCLKNCAGESNNKVTSAYYKCILKCRINEYINYCSKTYQDGLNILKNSSGIQWNIYNMYRREMTLTVLDLIASFPNYDLEKYPMRTKSQLTREIYTDALIDAYANAHFNINDIENSLTRPPGLVTWINRLDFYTGNFPGDVPGLTANSINYSFTNGNSNDSPIYGYRLNNDSRNPIQIPLNEYVYNMLITYLRDSQSVIQKIDFNLTNQQTRTYNTGLTLSPIYQSTITLSLLGQDGSIPPKFDKYTHFLSYVKTAPGDARPSSSRARNVCFGWMHYSVNDYSTILGGYNTIFDTITTQIPAVKARHLSTPSFVMPGPGHTGGNLVVLSTEIEFQCIVLNPAFYKMRIRYVAYSPNRSISLRVNIRGEAVNYQHPIPNIGSTVQSPGDTANPKYDHFQYLDIPISLGLLGITNIAITRLDSISNNTLIIDKIEFIPDV

SEQ ID NO: 175 - protein, 1275 aa, Bacillus sp.
LIGGHLMNQNYGSYDNNEMEIIDYGMRNARYPYASPPGAHLQNMNHTEWINMCAGVETSDTTSAVRDGLIIGTGVAWALLGLIPGIGPAASAIAGLFNVLIPYWWPEAAGDPGTPQAQYSWDQLMTAVEDMINVKIADLNRANAIARLEGIQLLAIDFYQARCDWLQDPGNPTKQAKVRDTFDDVEDYIKVSMPFFRASGYEVQMLAMYAHAANMHLLFLRDVVLNGLAWGFEQYDVDRYYSNVNTQANRGLRELLAVYTDYCVSIYNTGLQSQYGKGDWDKYNDFRKNMTLMVLDIVAIWPTFDTKNYSLPTKSQLTRLVYTRRVRGYDFHLAPSIGMLENTIVAVPKLFSWLVRLYYYVYDNYNQTGGYGYIKGLQFDYKNTLFNEILTTPLLGGTTNILQSVIVNDEANKSIYLTERKGKEGDGFFQLRYRYIDGTKSGVVGQTVDTTETFTPLGMPCRRDEIPSTNCDPCDPNNPCRVGTTDTNDPCMDNQLYSHRLAHVGGGADTTNSLTYLAYLGYGWSHFSADTNNLVDPDRITQIPAVKAHLLSGGAKVIKSPGSTGGDLVELTTGSDYEFMQIYTSMIAGQGAYRVRIRYACNMQTTVDIFMTGVTGKFIAPTTTTDMTNLTYDMFSYLDTVVYSYSAAADFQDIIRMYATGSGSGSFVIDKIEFIPITGSLTEYEAKQSLEKAWKAVNALFTNDTKSTLRLDVTDYDVDQAANKVDCMSDDMFPKEKMMLRDQVKHAKRLSQARNLLNYGDFESPNWSNANGWKVSNSVTVQASHPIARGRYLNMPGARSIEFSNTLYPTYAYQKVDESKLKPYTRYWVRGFVGNSRDLELFVTRYGEEVHTTMNIPTYSVNTRAPIERGSTQFGTMQVDYMMSSDPCQMNAYLPSSSDMPLASPTMGCEERAHFVFPIDVGEIDQRTNLGIEIGFKISSPEGMAQLDNIEIIEAQPLTGEALALVKKREQKWKKERERQCMETEKALASATQAVKSLFTSAEYNRLKPTTMMQDILSAEAKVNAIPYVRHPEFEDISGMNALIFQQLQSVIMTAINLYSRRNVIRNGDFSEGLSNWHATAGADVQERDGGSHVLVISQWDANVSQDVCVQPERGYVLRVTARKEGSGKGYVTISDCTEENTKTVTFTSDEMVNMPRSSVSPQRSRESSVCDNLDRYSESFGIVPDMNRMNYTTENAHMEACSCGCNNTIHKPATGYQEMAYQSQPSMPNMTSPSSRYITKTIEIFPETNRMRIEMGETEGTFVVESIELMCMED

SEQ ID NO: 176 - protein, 1269 aa, Artificial sequence
  variant of native sequence
MNQNYGSYDNNEMEIIDYGMRNARYPYASPPGAHLQNMNHTEWINMCAGVETSDTTSAVRDGLIIGTGVAWALLGLIPGIGPAASAIAGLFNVLIPYWWPEAAGDPGTPQAQYSWDQLMTAVEDMINVKIADLNRANAIARLEGIQLLAIDFYQARCDWLQDPGNPTKQAKVRDTFDDVEDYIKVSMPFFRASGYEVQMLAMYAHAANMHLLFLRDVVLNGLAWGFEQYDVDRYYSNVNTQANRGLRELLAVYTDYCVSIYNTGLQSQYGKGDWDKYNDFRKNMTLMVLDIVAIWPTFDTKNYSLPTKSQLTRLVYTRRVRGYDFHLAPSIGMLENTIVAVPKLFSWLVRLYYYVYDNYNQTGGYGYIKGLQFDYKNTLFNEILTTPLLGGTTNILQSVIVNDEANKSIYLTERKGKEGDGFFQLRYRYIDGTKSGVVGQTVDTTETFTPLGMPCRRDEIPSTNCDPCDPNNPCRVGTTDTNDPCMDNQLYSHRLAHVGGGADTTNSLTYLAYLGYGWSHFSADTNNLVDPDRITQIPAVKAHLLSGGAKVIKSPGSTGGDLVELTTGSDYEFMQIYTSMIAGQGAYRVRIRYACNMQTTVDIFMTGVTGKFIAPTTTTDMTNLTYDMFSYLDTVVYSYSAAADFQDIIRMYATGSGSGSFVIDKIEFIPITGSLTEYEAKQSLEKAWKAVNALFTNDTKSTLRLDVTDYDVDQAANKVDCMSDDMFPKEKMMLRDQVKHAKRLSQARNLLNYGDFESPNWSNANGWKVSNSVTVQASHPIARGRYLNMPGARSIEFSNTLYPTYAYQKVDESKLKPYTRYWVRGFVGNSRDLELFVTRYGEEVHTTMNIPTYSVNTRAPIERGSTQFGTMQVDYMMSSDPCQMNAYLPSSSDMPLASPTMGCEERAHFVFPIDVGEIDQRTNLGIEIGFKISSPEGMAQLDNIEIIEAQPLTGEALALVKKREQKWKKERERQCMETEKALASATQAVKSLFTSAEYNRLKPTTMMQDILSAEAKVNAIPYVRHPEFEDISGMNALIFQQLQSVIMTAINLYSRRNVIRNGDFSEGLSNWHATAGADVQERDGGSHVLVISQWDANVSQDVCVQPERGYVLRVTARKEGSGKGYVTISDCTEENTKTVTFTSDEMVNMPRSSVSPQRSRESSVCDNLDRYSESFGIVPDMNRMNYTTENAHMEACSCGCNNTIHKPATGYQEMAYQSQPSMPNMTSPSSRYITKTIEIFPETNRMRIEMGETEGTFVVESIELMCMED

SEQ ID NO: 177 - protein, 671 aa, Artificial sequence
  variant of native sequence
MNQNYGSYDNNEMEIIDYGMRNARYPYASPPGAHLQNMNHTEWINMCAGVETSDTTSAVRDGLIIGTGVAWALLGLIPGIGPAASAIAGLFNVLIPYWWPEAAGDPGTPQAQYSWDQLMTAVEDMINVKIADLNRANAIARLEGIQLLAIDFYQARCDWLQDPGNPTKQAKVRDTFDDVEDYIKVSMPFFRASGYEVQMLAMYAHAANMHLLFLRDVVLNGLAWGFEQYDVDRYYSNVNTQANRGLRELLAVYTDYCVSIYNTGLQSQYGKGDWDKYNDFRKNMTLMVLDIVAIWPTFDTKNYSLPTKSQLTRLVYTRRVRGYDFHLAPSIGMLENTIVAVPKLFSWLVRLYYYVYDNYNQTGGYGYIKGLQFDYKNTLFNEILTTPLLGGTTNILQSVIVNDEANKSIYLTERKGKEGDGFFQLRYRYIDGTKSGVVGQTVDTTETFTPLGMPCRRDEIPSTNCDPCDPNNPCRVGTTDTNDPCMDNQLYSHRLAHVGGGADTTNSLTYLAYLGYGWSHFSADTNNLVDPDRITQIPAVKAHLLSGGAKVIKSPGSTGGDLVELTTGSDYEFMQIYTSMIAGQGAYRVRIRYACNMQTTVDIFMTGVTGKFIAPTTTTDMTNLTYDMFSYLDTVVYSYSAAADFQDIIRMYATGSGSGSFVIDKIEFIPI

SEQ ID NO: 178 - protein, 197 aa, Bacillus sp.
VEVISLHPKNYGKDNEWRHIGSSNDILLEGKAQSAATIEYAESVHANLSFCGMLHIPHGFVYIPNSTRQLTYSLADLFVMKETSQRTIVVEDCGPVDVTLNVLKLVGNIPYIATAMVQGDNGKTYDSSPKEENQIHLSYTDYIQVDTVLKLSVASLPEYSIQEDIVKISDFQVTPVQDQGSNLLRFTGTFSFQNIPQ

SEQ ID NO: 179 - protein, 1146 aa, Unknown
  Unknown organism from environmental sample
MKKIKFKYCIQGDLNMNQKNYDIIGASTNGTNKLLEGYNIIISPYEAPTSVTTTIEITGTILSDLGVPGASSVSLLLNKLLNILWPNDANTVWGTFAKETADLLNEVLSADDPVVIQANENLEGLKNTLDLYLQALKEWKNDPQNPASQERVRTRFRNVDDDFTHDMPSFAKVGYETKLLTVYAQAANLHLLLLRDASMFGEGWGMTQTNINDNYNRQLRLTAHHTDYSVKWYNAGLEKLKGNLTGENWYTYNRFRREMTLMVLDIVALFPNYDARMYPIATSSELTRMIYTDPIAYTQSDPWYKMTNLSFSSIENSAIPIPSFFRWLKSVSINSQWWGSGSNQTYYWVGHELVYSNSNYNQSLKVKYGDPNSYIEPPDSISFSSTDVYRTISVVRNSISNYIVSEVQFNSISNTNQVSEEIYKHQSNWSRRETKDSITELSLAANPPTTFGNVAEYSHRLAYISEAYQSHNPSKYPAYIPVFGWTHTSVRYDNKIFPDKITQIPAVKSSSSEGGTWQNIAKGPGFTGGDVTTAVSPAVITDVIKIHVTLDTNSLSQKYRARLRYASNANVNATLYTNSSSNYNFELTKGTTETFTTYYSYQYVDIPGSIQFNTTSDTVSVYLHMDSTTNANVHVDRIEFIPVDENYDERVTLEKAQKAVNALFTAGRHALQTDVTDYKVDQVSILVDCVSGELYQSEKRELLSLVKYAKRLSYSRNLLLDPTFDSINSSEENGWYGSNGIAIGNGNFVFKGNYLIFSGTNDTQYPTYLYQKIDESKLKEYTRYKLRGFIESSQDLEAYVIRYDAKHETLDVSNNLFPDISPVNACGEPNRCAVLPYLDENPRLECSSIQDGILSDSHSFSLNIDTGSIDSNENVGIWVLFKISTPEGYAKFGNLEVIENGPVIGEALARVKRQETKWRNQLIQLRTETQAIYTRAKQALDNLFANAQDSHLKIGATFASIVAARKIVQSIREAYMSWLSIVPDVNYPIFTELNERVQQAFQLYDVRNVVRNGRFLSGLSDWIVTSDVKVQEDNGNNVLVLSNWDAQVLQCLKLYQDRGYILRVTARKEGLGEGYVTITDEEGHTDQLTFGTCEEIDASNTFVSTGYITKELEFFPDTEKVRIEIGETEGTFQVESVELFLMEDLC

SEQ ID NO: 180 - protein, 628 aa, Artificial sequence
  variant of native sequence
MNQKNYDIIGASTNGTNKLLEGYNIIISPYEAPTSVTTTIEITGTILSDLGVPGASSVSLLLNKLLNILWPNDANTVWGTFAKETADLLNEVLSADDPVVIQANENLEGLKNTLDLYLQALKEWKNDPQNPASQERVRTRFRNVDDDFTHDMPSFAKVGYETKLLTVYAQAANLHLLLLRDASMFGEGWGMTQTNINDNYNRQLRLTAHHTDYSVKWYNAGLEKLKGNLTGENWYTYNRFRREMTLMVLDIVALFPNYDARMYPIATSSELTRMIYTDPIAYTQSDPWYKMTNLSFSSIENSAIPIPSFFRWLKSVSINSQWWGSGSNQTYYWVGHELVYSNSNYNQSLKVKYGDPNSYIEPPDSISFSSTDVYRTISVVRNSISNYIVSEVQFNSISNTNQVSEEIYKHQSNWSRRETKDSITELSLAANPPTTFGNVAEYSHRLAYISEAYQSHNPSKYPAYIPVFGWTHTSVRYDNKIFPDKITQIPAVKSSSSEGGTWQNIAKGPGFTGGDVTTAVSPAVITDVIKIHVTLDTNSLSQKYRARLRYASNANVNATLYTNSSSNYNFELTKGTTETFTTYYSYQYVDIPGSIQFNTTSDTVSVYLHMDSTTNANVHVDRIEFIPV

SEQ ID NO: 181 - protein, 1131 aa, Artificial sequence
  variant of native sequence
MNQKNYDIIGASTNGTNKLLEGYNIIISPYEAPTSVTTTIEITGTILSDLGVPGASSVSLLLNKLLNILWPNDANTVWGTFAKETADLLNEVLSADDPVVIQANENLEGLKNTLDLYLQALKEWKNDPQNPASQERVRTRFRNVDDDFTHDMPSFAKVGYETKLLTVYAQAANLHLLLLRDASMFGEGWGMTQTNINDNYNRQLRLTAHHTDYSVKWYNAGLEKLKGNLTGENWYTYNRFRREMTLMVLDIVALFPNYDARMYPIATSSELTRMIYTDPIAYTQSDPWYKMTNLSFSSIENSAIPIPSFFRWLKSVSINSQWWGSGSNQTYYWVGHELVYSNSNYNQSLKVKYGDPNSYIEPPDSISFSSTDVYRTISVVRNSISNYIVSEVQFNSISNTNQVSEEIYKHQSNWSRRETKDSITELSLAANPPTTFGNVAEYSHRLAYISEAYQSHNPSKYPAYIPVFGWTHTSVRYDNKIFPDKITQIPAVKSSSSEGGTWQNIAKGPGFTGGDVTTAVSPAVITDVIKIHVTLDTNSLSQKYRARLRYASNANVNATLYTNSSSNYNFELTKGTTETFTTYYSYQYVDIPGSIQFNTTSDTVSVYLHMDSTTNANVHVDRIEFIPVDENYDERVTLEKAQKAVNALFTAGRHALQTDVTDYKVDQVSILVDCVSGELYQSEKRELLSLVKYAKRLSYSRNLLLDPTFDSINSSEENGWYGSNGIAIGNGNFVFKGNYLIFSGTNDTQYPTYLYQKIDESKLKEYTRYKLRGFIESSQDLEAYVIRYDAKHETLDVSNNLFPDISPVNACGEPNRCAVLPYLDENPRLECSSIQDGILSDSHSFSLNIDTGSIDSNENVGIWVLFKISTPEGYAKFGNLEVIENGPVIGEALARVKRQETKWRNQLIQLRTETQAIYTRAKQALDNLFANAQDSHLKIGATFASIVAARKIVQSIREAYMSWLSIVPDVNYPIFTELNERVQQAFQLYDVRNVVRNGRFLSGLSDWIVTSDVKVQEDNGNNVLVLSNWDAQVLQCLKLYQDRGYILRVTARKEGLGEGYVTITDEEGHTDQLTFGTCEEIDASNTFVSTGYITKELEFFPDTEKVRIEIGETEGTFQVESVELFLMEDLC

SEQ ID NO: 182 - protein, 713 aa, Unknown
  Unknown organism from environmental sample
MESIICMFRVLYIRNYEHTGGIKMKPYQNENEYEILDAFPKYSNIVNVYSRYPLANNPQVPLKNTNYKDWLNMCQTITPLCTPIDVDSNLVKVAIGVLGAIFKAMPGPGTAVGLVLKSFSTIIPILWPNDTTPIWKEFTKQGLQLFRPELGRDAIEIIGNDVQAEYNSLKIMMQDFETKFAIWEPNRTRANAIAVTTAFSSVNNQIIRLKERFLIAAENRPAFLNLYAQTANIDLILYQRGSVNGDKWVADINNRSISPFSSKDYYQSLKSKIQEYTNYCAETYRNSLDILKNKPNIHWDIYNRYRREATLGALDLVALFPNYDICIYPIQTKTELTRKVYMPSFFLQALEQSGNLESLENQLTHPPSLFTWLNELNLYTISENFNPALRVFSLSGLQAKYRYTQNSTILPNPPAQGITNGTPIPIIGLNNLFIYKLSMSQYHDPNGCYPIAGISDMTFYKSDYNGNASATQTYQAGRNSNNVIDTFMNGPQNATTSNNISIKDTNHVLSDIKMNYSRVGGIYPSYTFGYSFAWTHTSVDPDNLIVPNRITQIPAVKAYSLTSPARVIAGPGHTGGDLVALLNSGTQAGRMQIQCKTGSFTEATRRYGIRIRYAANNEFIVSLSYTLQGGNIMGTTFGTERTFSRLNNIIPTDLKYAEFKYKEYNQIITINSPQNTIVTIAIQQQNPISNDQLIIDRIEFYPIDQGVVACTVN

SEQ ID NO: 183 - protein, 680 aa, Artificial sequence
  variant of native sequence
MKPYQNENEYEILDAFPKYSNIVNVYSRYPLANNPQVPLKNTNYKDWLNMCQTITPLCTPIDVDSNLVKVAIGVLGAIFKAMPGPGTAVGLVLKSFSTIIPILWPNDTTPIWKEFTKQGLQLFRPELGRDAIEIIGNDVQAEYNSLKIMMQDFETKFAIWEPNRTRANAIAVTTAFSSVNNQIIRLKERFLIAAENRPAFLNLYAQTANIDLILYQRGSVNGDKWVADINNRSISPFSSKDYYQSLKSKIQEYTNYCAETYRNSLDILKNKPNIHWDIYNRYRREATLGALDLVALFPNYDICIYPIQTKTELTRKVYMPSFFLQALEQSGNLESLENQLTHPPSLFTWLNELNLYTISENFNPALRVFSLSGLQAKYRYTQNSTILPNPPAQGITNGTPIPIIGLNNLFIYKLSMSQYHDPNGCYPIAGISDMTFYKSDYNGNASATQTYQAGRNSNNVIDTFMNGPQNATTSNNISIKDTNHVLSDIKMNYSRVGGIYPSYTFGYSFAWTHTSVDPDNLIVPNRITQIPAVKAYSLTSPARVIAGPGHTGGDLVALLNSGTQAGRMQIQCKTGSFTEATRRYGIRIRYAANNEFIVSLSYTLQGGNIMGTTFGTERTFSRLNNIIPTDLKYAEFKYKEYNQIITINSPQNTIVTIAIQQQNPISNDQLIIDRIEFYPI

SEQ ID NO: 184 - protein, 690 aa, Artificial sequence
  variant of native sequence
MKPYQNENEYEILDAFPKYSNIVNVYSRYPLANNPQVPLKNTNYKDWLNMCQTITPLCTPIDVDSNLVKVAIGVLGAIFKAMPGPGTAVGLVLKSFSTIIPILWPNDTTPIWKEFTKQGLQLFRPELGRDAIEIIGNDVQAEYNSLKIMMQDFETKFAIWEPNRTRANAIAVTTAFSSVNNQIIRLKERFLIAAENRPAFLNLYAQTANIDLILYQRGSVNGDKWVADINNRSISPFSSKDYYQSLKSKIQEYTNYCAETYRNSLDILKNKPNIHWDIYNRYRREATLGALDLVALFPNYDICIYPIQTKTELTRKVYMPSFFLQALEQSGNLESLENQLTHPPSLFTWLNELNLYTISENFNPALRVFSLSGLQAKYRYTQNSTILPNPPAQGITNGTPIPIIGLNNLFIYKLSMSQYHDPNGCYPIAGISDMTFYKSDYNGNASATQTYQAGRNSNNVIDTFMNGPQNATTSNNISIKDTNHVLSDIKMNYSRVGGIYPSYTFGYSFAWTHTSVDPDNLIVPNRITQIPAVKAYSLTSPARVIAGPGHTGGDLVALLNSGTQAGRMQIQCKTGSFTEATRRYGIRIRYAANNEFIVSLSYTLQGGNIMGTTFGTERTFSRLNNIIPTDLKYAEFKYKEYNQIITINSPQNTIVTIAIQQQNPISNDQLIIDRIEFYPIDQGVVACTVN

SEQ ID NO: 185 - protein, 334 aa, Unknown
  Unknown organism from environmental sample
LHIKKTENYNHNKGGKNMKKPSKKTKQILSLAMIGAIGTSVAFASPDSVSAAQINPTQVNAQTPGSVSISDWKAPIQQTYQTYKKRQPALFLSKDVIIKNTKIYNSYVEADGSPTITDSKSLFVGRSILTNISNQEQTLTTNQFSKTFESSVTNSTTQGFNFGVSTSASFGIPLIGATNVQISTEYNFSNTVEKRKAESYTYTAIPQNIVVPANSSVEVLVSLNTSKISGNVNLLTHVDGTLYFNTNPNNPGSMRVMGLKPFLSSFGSIDKNIKPHPQNGAYVIGKGKYSAEYGSDFSVTVRPINKPNVASTKLSESANEGYTYTVKPEVKKEQ

SEQ ID NO: 186 - protein, 284 aa, Artificial sequence
  variant of native sequence
MAQINPTQVNAQTPGSVSISDWKAPIQQTYQTYKKRQPALFLSKDVIIKNTKIYNSYVEADGSPTITDSKSLFVGRSILTNISNQEQTLTTNQFSKTFESSVTNSTTQGFNFGVSTSASFGIPLIGATNVQISTEYNFSNTVEKRKAESYTYTAIPQNIVVPANSSVEVLVSLNTSKISGNVNLLTHVDGTLYFNTNPNNPGSMRVMGLKPFLSSFGSIDKNIKPHPQNGAYVIGKGKYSAEYGSDFSVTVRPINKPNVASTKLSESANEGYTYTVKPEVKKEQ

SEQ ID NO: 187 - protein, 317 aa, Artificial sequence
  variant of native sequence
MKKPSKKTKQILSLAMIGAIGTSVAFASPDSVSAAQINPTQVNAQTPGSVSISDWKAPIQQTYQTYKKRQPALFLSKDVIIKNTKIYNSYVEADGSPTITDSKSLFVGRSILTNISNQEQTLTTNQFSKTFESSVTNSTTQGFNFGVSTSASFGIPLIGATNVQISTEYNFSNTVEKRKAESYTYTAIPQNIVVPANSSVEVLVSLNTSKISGNVNLLTHVDGTLYFNTNPNNPGSMRVMGLKPFLSSFGSIDKNIKPHPQNGAYVIGKGKYSAEYGSDFSVTVRPINKPNVASTKLSESANEGYTYTVKPEVKKEQ

SEQ ID NO: 188 - protein, 713 aa, Unknown
  Unknown organism from environmental sample
MNQNNNEYEITDVNTPSYPSNRINNYSRYPFANDPNQLLQQTNYKDWLNICQGNNQNSGNLKALTDAGAGVSAGIIVTGTMIAAFAALAVAPFPIVGAIVGGIVISFGTLLPLVWPGGSGDRTVWTQFFALGETLLGKSLTDEAKKTAGETVDGFEKVLTNYEDALNKWMDLKKEQIPGSPPTPELKEAAENVKNRLDSIHLQFDGNMAHLGNPQSTYKEVLLSSYAHAANLHLNLLQQGVRFADQWNQDIYSSQIVPAAGTSVAYLKLLQERIQEYVNYCTKTYRSGLNILENSNDITWDIYNTYRRDLTLAVLDLVAAFPNYDPTYYPIDTKIQLTRTIYSDLLGITQSGRKNLEALENALTMRPNLYRILRGFTFNTTFGSGVNYLSGISNTRGLIKTDPSNKDKQPFYGQSNGKQDPLDFANGLNIFRVNLLRNKRYIPSPVPPSLFSADQITDLKLYYGNATEYHHYQPANQGLTTENTDLSFPPKNDEYLNAILMTSPGTIYDNPTNIYSFAWTKKDIDQQNNIIINAITQIPAVKGNELGSKSRVIQGPGHTSGDLVDLKDSIVLKCQYTGPQQSYFVRIRYASNGILNNRATIGLTIPGVTGQSITLSETFSGTDYNVLEFQNFKSYQFNGQIQLNPSQNIFIYLNRLDQNANTTLLIDKIEFIPAPLPRILSEQKLKKVKQKVNDLFIDSENGCFCPSHEKDLR

SEQ ID NO: 189 - protein, 674 aa, Artificial sequence
  variant of native sequence
MNQNNNEYEITDVNTPSYPSNRINNYSRYPFANDPNQLLQQTNYKDWLNICQGNNQNSGNLKALTDAGAGVSAGIIVTGTMIAAFAALAVAPFPIVGAIVGGIVISFGTLLPLVWPGGSGDRTVWTQFFALGETLLGKSLTDEAKKTAGETVDGFEKVLTNYEDALNKWMDLKKEQIPGSPPTPELKEAAENVKNRLDSIHLQFDGNMAHLGNPQSTYKEVLLSSYAHAANLHLNLLQQGVRFADQWNQDIYSSQIVPAAGTSVAYLKLLQERIQEYVNYCTKTYRSGLNILENSNDITWDIYNTYRRDLTLAVLDLVAAFPNYDPTYYPIDTKIQLTRTIYSDLLGITQSGRKNLEALENALTMRPNLYRILRGFTFNTTFGSGVNYLSGISNTRGLIKTDPSNKDKQPFYGQSNGKQDPLDFANGLNIFRVNLLRNKRYIPSPVPPSLFSADQITDLKLYYGNATEYHHYQPANQGLTTENTDLSFPPKNDEYLNAILMTSPGTIYDNPTNIYSFAWTKKDIDQQNNIIINAITQIPAVKGNELGSKSRVIQGPGHTSGDLVDLKDSIVLKCQYTGPQQSYFVRIRYASNGILNNRATIGLTIPGVTGQSITLSETFSGTDYNVLEFQNFKSYQFNGQIQLNPSQNIFIYLNRLDQNANTTLLIDKIEFIPA

SEQ ID NO: 190 - protein, 660 aa, Unknown
  Unknown organism from environmental sample
VKNMNSYQNKNEYELLDTSPNSSTMSTRYPSYPLAKNPQISMQNTNYKDWINMCTNNTLIPIEPLDLTWQNALVSVFGIASAVAGLLASPITGGTSIAAGAAIIANILPLTFPANAESVPNKLMDATQELLGPLEEYTRNRANSELLSLSSQLEAFKGLFDYWLANRQNPSATNSVSARFTAIHNNFIGAMALFKIPGYEALLLPVYAQAARLHLLHLRDGITYADEWQLADPTNATYAGDYHYSEFKKYSAQYADHCEVVVNNQLNKIKNTTGKTWKEYNEYRRKMILSVFDIVAEFSTFDPILYKGAINREILTRKIYTDPVNFTPGSSIANDENKYTIYPTPVKELVAIRLYTNVASEQYAGFIGNKNRYLSLSGGEPLDGPLIGKSVYENVVAGVPTTESIYEVGVNGYPNDYPRNIGLRWGSLTGFQNYYAGGSTNLGSLTSVSVPPKNNAPINNTNFTHRLSDVILPGNSGSSFAWTHVEINPTGNYLSTNQINLISATKTSSYSNFNFIEGPRFTGGYLIRNASGTSCQSSYPLKLKPGGSSTSFRVRIRYGSNIAGKVYFRFNGKDSSPTSFPSTNFSAAYKYDTFRVVELLSTLQNFTGGELIIIIELDSFISFFVLERLELIPMTGMPTEYTEPQKLETAQKAVNDLFTN

SEQ ID NO: 191 - protein, 657 aa, Artificial sequence
  variant of native sequence
MNSYQNKNEYELLDTSPNSSTMSTRYPSYPLAKNPQISMQNTNYKDWINMCTNNTLIPIEPLDLTWQNALVSVFGIASAVAGLLASPITGGTSIAAGAAIIANILPLTFPANAESVPNKLMDATQELLGPLEEYTRNRANSELLSLSSQLEAFKGLFDYWLANRQNPSATNSVSARFTAIHNNFIGAMALFKIPGYEALLLPVYAQAARLHLLHLRDGITYADEWQLADPTNATYAGDYHYSEFKKYSAQYADHCEVVVNNQLNKIKNTTGKTWKEYNEYRRKMILSVFDIVAEFSTFDPILYKGAINREILTRKIYTDPVNFTPGSSIANDENKYTIYPTPVKELVAIRLYTNVASEQYAGFIGNKNRYLSLSGGEPLDGPLIGKSVYENVVAGVPTTESIYEVGVNGYPNDYPRNIGLRWGSLTGFQNYYAGGSTNLGSLTSVSVPPKNNAPINNTNFTHRLSDVILPGNSGSSFAWTHVEINPTGNYLSTNQINLISATKTSSYSNFNFIEGPRFTGGYLIRNASGTSCQSSYPLKLKPGGSSTSFRVRIRYGSNIAGKVYFRFNGKDSSPTSFPSTNFSAAYKYDTFRVVELLSTLQNFTGGELIIIIELDSFISFFVLERLELIPMTGMPTEYTEPQKLETAQKAVNDLFTN

SEQ ID NO: 192 - protein, 631 aa, Artificial sequence
  variant of native sequence
MNSYQNKNEYELLDTSPNSSTMSTRYPSYPLAKNPQISMQNTNYKDWINMCTNNTLIPIEPLDLTWQNALVSVFGIASAVAGLLASPITGGTSIAAGAAIIANILPLTFPANAESVPNKLMDATQELLGPLEEYTRNRANSELLSLSSQLEAFKGLFDYWLANRQNPSATNSVSARFTAIHNNFIGAMALFKIPGYEALLLPVYAQAARLHLLHLRDGITYADEWQLADPTNATYAGDYHYSEFKKYSAQYADHCEVVVNNQLNKIKNTTGKTWKEYNEYRRKMILSVFDIVAEFSTFDPILYKGAINREILTRKIYTDPVNFTPGSSIANDENKYTIYPTPVKELVAIRLYTNVASEQYAGFIGNKNRYLSLSGGEPLDGPLIGKSVYENVVAGVPTTESIYEVGVNGYPNDYPRNIGLRWGSLTGFQNYYAGGSTNLGSLTSVSVPPKNNAPINNTNFTHRLSDVILPGNSGSSFAWTHVEINPTGNYLSTNQINLISATKTSSYSNFNFIEGPRFTGGYLIRNASGTSCQSSYPLKLKPGGSSTSFRVRIRYGSNIAGKVYFRFNGKDSSPTSFPSTNFSAAYKYDTFRVVELLSTLQNFTGGELIIIIELDSFISFFVLERLELIPM

SEQ ID NO: 193 - protein, 575 aa, Unknown
  Unknown organism from environmental sample
LFKKYEEKVVNPMYTNAMKNTLKIETTDYEIDQAASSIECMSHEKYPQEKMILWDEVKQAKQLSQSRNLLYNGDFKDASNGWKTSYTIEIRNNSPIFKGNYLHMFGAREVLDEVFPTYIYQKIDESKLKPYTRYRVRGFVGSSQDLELVVARYGKEIDAIMSVPHEGLAYMQANPSCGDYRCDSSSHSMMSQGYPTPVTDGYASDMYACPSDRVKKHVKCHDRHPFDFHIDTGELDTNTNLGILVLFKISHPNGYATLGNLEVIEEGPLTDEALEHVNHKEKKWNRHIEKARMETQQAYDPAKQAVDALFTSAQELHYHTTLNHIKNANQLVQSIPYVNHAWLPDAPGMNYDLYQGLNARIMQAYNVYDARNVITNGDFTQGLQGWHATGNAVVQQMDGASVLVLSNWSAGVSQNLHAQDHHGYVLRVIAKKEGTGKGYVTMMDCNGKQETLTFTSCEEGYMTKTVEVFPESDRVRIEIGETEGTFYIDSIELLCMKGYTSNYNQNTGNMYEQSYNGNYNQNTSDVYHQGYTNNYNKDSSSMYNQNYTNNDDQHSGCTCNQGHNPGCTCNQRYNR

SEQ ID NO: 194 - protein, 387 aa, Bacillus sp.
MKSISKKVMAGLLVGATSLSIWAPSSQAAPANNAYHSIHLAANTWLKWDVIWDSTNDDAGIVLYNGGISDNEQFVFFPLDGGAYAIVNKNSGKPVATGSGWIAGNTLSHNSEGVKQANWTGAATEKWYLRDQGNNNYEIVNQGYGKVASYAKAGIGPLGPEYVDLDNSNPSDNDRLFHIPAAARSTFSLPTLPAIGTRPNAPDYNPNGSIDQQLPQASNSVVVGASLIPCIMVKDNGASDYTKIHNSPYYVLEKEEYWEKVRSEIIPAGSTSKYTVKTGVSTVDQQKMTDTLAMNFGADLGFKFGDQSASLKYGISKTLQTEVSKTSTDSKEETEEKNLTSINNKNTGFTVYQLVTKYTLKRTDGSVVSDPWTVRDKEQTIVRPITN

SEQ ID NO: 195 - protein, 360 aa, Artificial sequence
  variant of native sequence
MAPANNAYHSIHLAANTWLKWDVIWDSTNDDAGIVLYNGGISDNEQFVFFPLDGGAYAIVNKNSGKPVATGSGWIAGNTLSHNSEGVKQANWTGAATEKWYLRDQGNNNYEIVNQGYGKVASYAKAGIGPLGPEYVDLDNSNPSDNDRLFHIPAAARSTFSLPTLPAIGTRPNAPDYNPNGSIDQQLPQASNSVVVGASLIPCIMVKDNGASDYTKIHNSPYYVLEKEEYWEKVRSEIIPAGSTSKYTVKTGVSTVDQQKMTDTLAMNFGADLGFKFGDQSASLKYGISKTLQTEVSKTSTDSKEETEEKNLTSINNKNTGFTVYQLVTKYTLKRTDGSVVSDPWTVRDKEQTIVRPITN

SEQ ID NO: 196 - protein, 264 aa, Unknown
  Unknown organism from environmental sample
LPSFIAYFYADCLGTAHTMMEVFKAEEYPERGTPVHATEKQPVDRQIFVSNRIETFSLPEYRLGKLGDIPHYQGYDTNLPETTPSVIVAITTLPAMMVNDTWEGKQKMQTSPYYQLIKKQYWKKQDAHILSPGREHVITETHGMTQTDVKSMTEKSGLTMQGDAGFTFQAITASLSSTITRELDISRSTTIQEMKEHKVEDTIRNTSTEKLAWARYVLVSEYHIERVDGTFVSTPWTYIHETDTRETVWPTGEKQKIMAVPVKK

SEQ ID NO: 197 - protein, 246 aa, Artificial sequence
  variant of native sequence
MMEVFKAEEYPERGTPVHATEKQPVDRQIFVSNRIETFSLPEYRLGKLGDIPHYQGYDTNLPETTPSVIVAITTLPAMMVNDTWEGKQKMQTSPYYQLIKKQYWKKQDAHILSPGREHVITETHGMTQTDVKSMTEKSGLTMQGDAGFTFQAITASLSSTITRELDISRSTTIQEMKEHKVEDTIRNTSTEKLAWARYVLVSEYHIERVDGTFVSTPWTYIHETDTRETVWPTGEKQKIMAVPVKK

SEQ ID NO: 198 - protein, 951 aa, Bacillus sp.
MIMQMVTKAMTPKLGALPDFIDDFNGIFGFMDNITGVMSTIFGIDTGDSSIDNVLNNQELLQEMLDQMSTMQSSIQDILEQQGISADIEKQILALTTDLATSINAELGKIEGILNTYLPAISNMLSNIYEQTSMIDQKVDKLLALMTFALKELDYIKDNVVLNSSIVEITPHVQKLVYVNKKFLSLTRGFLQGEDVSIDSMQEIQEWAKSILATEMNSFEFSVDTLHNIIIGDNLYKRSALKTFSDVLLDDADQYGDFGTPLAKFYTFFSSLATLQINAYLCLTFARKVLGLSEIDYQVTMQDRIEQQNQMFVNLIQDKNYSNVLEIEGIYPMPQQSGDCNSLDLQAKSGYALIGLEFFMDNGIYKAKAYQAKIDKNFSIHADTVEEIISDDLSKVFLNTMNQSEYFRYPLFGELKGVPNTIITRIGFGTKYDESRKVKAFAYIDADFSPYDPKSGYISTEGTQTFQIEGTEDKNWCYSAWPIGLIGDLYMTPLKSLSLNVDVDLHGGNTLNMSGESYFSTILSREYNANFILFPYTNNSGLIDNNLIQNGNLEDQDKYWEGTEPSFFAEGEGTFGSNALKVQAQGAFDQIVKLEPNTTYRLTAFTKVKDSNYSKGKIGIRDMYDYRVEKSFLHTRYNQTKVEFTTGADTSKLSVFIQGGGDQESIAWADNIELYKVHQQDNMISDFDFDTYIYSNMCWKLSGGGDFVEKEGLFNSKALKITNSGGAEQEVKLKANTNYIFTAYVKVDNTTAQIGCGSNQVTCNSTSYTPVKLKFRTGEDPSTTEGSIYCSNPNDSGTVWADDFVLYEVPNLIINGDFEQMDLSSWNPSPTDVGKIYLRSGAGMSHSTAIVLAGEGQISQKVPLKPYTKYRLTAYVRVPNGVTALLGYGNGGNDDYRVHCTSTEFKQESLVFTTGANPLQSEDAIYLSTPDDGFKIATGDNFELYELDQIE

SEQ ID NO: 199 - protein, 949 aa, Artificial sequence
  variant of native sequence
MQMVTKAMTPKLGALPDFIDDFNGIFGFMDNITGVMSTIFGIDTGDSSIDNVLNNQELLQEMLDQMSTMQSSIQDILEQQGISADIEKQILALTTDLATSINAELGKIEGILNTYLPAISNMLSNIYEQTSMIDQKVDKLLALMTFALKELDYIKDNVVLNSSIVEITPHVQKLVYVNKKFLSLTRGFLQGEDVSIDSMQEIQEWAKSILATEMNSFEFSVDTLHNIIIGDNLYKRSALKTFSDVLLDDADQYGDFGTPLAKFYTFFSSLATLQINAYLCLTFARKVLGLSEIDYQVTMQDRIEQQNQMFVNLIQDKNYSNVLEIEGIYPMPQQSGDCNSLDLQAKSGYALIGLEFFMDNGIYKAKAYQAKIDKNFSIHADTVEEIISDDLSKVFLNTMNQSEYFRYPLFGELKGVPNTIITRIGFGTKYDESRKVKAFAYIDADFSPYDPKSGYISTEGTQTFQIEGTEDKNWCYSAWPIGLIGDLYMTPLKSLSLNVDVDLHGGNTLNMSGESYFSTILSREYNANFILFPYTNNSGLIDNNLIQNGNLEDQDKYWEGTEPSFFAEGEGTFGSNALKVQAQGAFDQIVKLEPNTTYRLTAFTKVKDSNYSKGKIGIRDMYDYRVEKSFLHTRYNQTKVEFTTGADTSKLSVFIQGGGDQESIAWADNIELYKVHQQDNMISDFDFDTYIYSNMCWKLSGGGDFVEKEGLFNSKALKITNSGGAEQEVKLKANTNYIFTAYVKVDNTTAQIGCGSNQVTCNSTSYTPVKLKFRTGEDPSTTEGSIYCSNPNDSGTVWADDFVLYEVPNLIINGDFEQMDLSSWNPSPTDVGKIYLRSGAGMSHSTAIVLAGEGQISQKVPLKPYTKYRLTAYVRVPNGVTALLGYGNGGNDDYRVHCTSTEFKQESLVFTTGANPLQSEDAIYLSTPDDGFKIATGDNFELYELDQIE

SEQ ID NO: 200 - protein, 691 aa, Unknown
  Unknown organism from environmental sample
VKKMNSYQNKNEYEILDASQNNSTMSNRYPRYPLANDPQASMQNTSYKEWLNMCDSNTQFVGDISTYSSPEAALSARDAVFTGINVANSILSHFGYFGVPFAGFSFQLIGALLGILWPGPDPFAALMVLVEELINDRIKDEIREHALLELAGLKDIMDLYRTRWLAWDLNKDNPDTEIRERAKEAVRLQYRIADNFFIQNMPKFGRADHGVLLLAVYAQAANLHLILLRDADVYGEKWGLGPDEIRDNYIRLQKKIREYKDHCVTFYNQGLNRFNHSNAQDWVSFNRFRTDMTITVLDLATLFPNYDPRIYPSAVKTELTREIYTDPVGYTEQGRPWYNPNNTTFATMENNARRRPSFTTWLNGVRIFTGHLSNFSAARNVWGGHELFERQNNDSEIMRKFGNTDTSTVPVRNWDFTDQNRTVFSIVSNASVFVVGPQPERGSQYGVSKINMHTAIHGNSFGGEFIYDVPNVLRPQAIVSELPAEDQQRPDARNHSHILSYISNFDAHRGGSGGNVSLLTYGWTHTSMDRNNRLERDRITQIDAVKGWGGLTGSVIPGPTGGNLVTIPGSPFDVFLRVQAPQIQTDYRIRLRFACVWPGTHSMWVNYGGISHPVQLLCNNTSGRPSNNLLESDFGYVVVPGIFSPSINPEIRFSAISGTPVLDKIEFIPLDMFNELFPGDREKTVNDLFIN

SEQ ID NO: 201 - protein, 688 aa, Artificial sequence
  variant of native sequence
MNSYQNKNEYEILDASQNNSTMSNRYPRYPLANDPQASMQNTSYKEWLNMCDSNTQFVGDISTYSSPEAALSARDAVFTGINVANSILSHFGYFGVPFAGFSFQLIGALLGILWPGPDPFAALMVLVEELINDRIKDEIREHALLELAGLKDIMDLYRTRWLAWDLNKDNPDTEIRERAKEAVRLQYRIADNFFIQNMPKFGRADHGVLLLAVYAQAANLHLILLRDADVYGEKWGLGPDEIRDNYIRLQKKIREYKDHCVTFYNQGLNRFNHSNAQDWVSFNRFRTDMTITVLDLATLFPNYDPRIYPSAVKTELTREIYTDPVGYTEQGRPWYNPNNTTFATMENNARRRPSFTTWLNGVRIFTGHLSNFSAARNVWGGHELFERQNNDSEIMRKFGNTDTSTVPVRNWDFTDQNRTVFSIVSNASVFVVGPQPERGSQYGVSKINMHTAIHGNSFGGEFIYDVPNVLRPQAIVSELPAEDQQRPDARNHSHILSYISNFDAHRGGSGGNVSLLTYGWTHTSMDRNNRLERDRITQIDAVKGWGGLTGSVIPGPTGGNLVTIPGSPFDVFLRVQAPQIQTDYRIRLRFACVWPGTHSMWVNYGGISHPVQLLCNNTSGRPSNNLLESDFGYVVVPGIFSPSINPEIRFSAISGTPVLDKIEFIPLDMFNELFPGDREKTVNDLFIN

SEQ ID NO: 202 - protein, 667 aa, Artificial sequence
  variant of native sequence
MNSYQNKNEYEILDASQNNSTMSNRYPRYPLANDPQASMQNTSYKEWLNMCDSNTQFVGDISTYSSPEAALSARDAVFTGINVANSILSHFGYFGVPFAGFSFQLIGALLGILWPGPDPFAALMVLVEELINDRIKDEIREHALLELAGLKDIMDLYRTRWLAWDLNKDNPDTEIRERAKEAVRLQYRIADNFFIQNMPKFGRADHGVLLLAVYAQAANLHLILLRDADVYGEKWGLGPDEIRDNYIRLQKKIREYKDHCVTFYNQGLNRFNHSNAQDWVSFNRFRTDMTITVLDLATLFPNYDPRIYPSAVKTELTREIYTDPVGYTEQGRPWYNPNNTTFATMENNARRRPSFTTWLNGVRIFTGHLSNFSAARNVWGGHELFERQNNDSEIMRKFGNTDTSTVPVRNWDFTDQNRTVFSIVSNASVFVVGPQPERGSQYGVSKINMHTAIHGNSFGGEFIYDVPNVLRPQAIVSELPAEDQQRPDARNHSHILSYISNFDAHRGGSGGNVSLLTYGWTHTSMDRNNRLERDRITQIDAVKGWGGLTGSVIPGPTGGNLVTIPGSPFDVFLRVQAPQIQTDYRIRLRFACVWPGTHSMWVNYGGISHPVQLLCNNTSGRPSNNLLESDFGYVVVPGIFSPSINPEIRFSAISGTPVLDKIEFIPL

SEQ ID NO: 203 - protein, 559 aa, Unknown
  Unknown organism from environmental sample
VKKVVNPMFTSGAKNTLKIETTDYQIDQVAHSIECMSEEQNPQKKMMLWDEIKQAKQLSRSRNLLHNGDFEDLFGGWTTSTHITIQVDNPIFKGNHLNIPGAGDIDGTLFPSYIYQKIDESKLKPNTRYRVRGFVGSSKNLKLVVTRYGKEIDASMDVPNDLAYMQPNLSCGGYRCDSSSQSVMSQGSPTPVTEGYASDMYSCPSNLGKKHVKCHDRHPFDFHIDTGELDINTNVGIWVLFKISNPDGYATLGNLEVIEEGPLTDESLAHVKQKEQKWHQQMEKKRMETQQAYAPAKQAVDALFANAQELQYHITLDHIQNADQLVQSIPYVHHAWLPDAPGMNYDGYQGLNASIMQARYLYDARNVITNGDFTQGLTGWHATGKVDVQQMAGAFVLVLSNWSAGVSQNIHVQHHCGYVLRVIAKKEGPGKGYVTMMDCNGKQETLTFTSCEEGYMTKTVEVFPESDRVRIEIGETEGTFYIDSIELICMKGYNSNYNQNTSNMYDQSYNRNYSQNTSDMYNQSYTNNYDQHSGCTCNQGHNNNDNQSSGCTCNQGYNS

SEQ ID NO: 204 - protein, 408 aa, Bacillus sp.
MIIVALIPNGEAFISQILGAVCPNNVEDNQLKYVQSQINRLDKKVEDLSAAILKSHYDILLKEIQLFENCVNILDSSDVYYSTGNVYENRRWHARHINQKFKELIRDCNKEILQAKELPMYTTVATAYLLFLKFIEKNGKGPKIKFDNASFNEEFMHDIQTAAKEYKIHIEYTYNAEAHRLREEMIAIAQKARSVTHAYLTGNESSFDDAVVRALKKMEDKYNELLKNFMRDGAASVLSGQNTIMNNLGKDIDNYRNKLNEQNKYYNRTWGNQAFRVIARIDTWVQESGKWYYYDHDMLLVNHIFYSGGKWYYLSPEKTDKLEKGQMATGWLSLPSNKMGVVMMFMYSKNVGGKYSNELPKIMELMKKSANTKFWLYFSPNGELVHNTKKTIGGKEYEFDKYGICLNP

SEQ ID NO: 205 - protein, 272 aa, Bacillus sp.
MLFLVLSFRGIFLLKNQRSVLMPIQEKFSFSELSAVGSNPNSVREKFKERFGTLPDGIAVNSETYYDAVKPAITEQYGHPCYKTLGEFTYQVGNGKPPSEAILGSNYAVNHGDEEASISLSVQGNWTETKTWSSETTTGLTISSKFTLEGVFESGAEFSVSTTVGESSSTSVSRSASSTVTVTVPPRSKKKVSMVGTMKQETMNFQAPLSVQGSFGANFPRKVEDHYFWFLGADNVLNSTTGTLTGKIKNTAVFNVQTEVGAAEPLDAKTPV

SEQ ID NO: 206 - protein, 251 aa, Artificial sequence
  variant of native sequence
MPIQEKFSFSELSAVGSNPNSVREKFKERFGTLPDGIAVNSETYYDAVKPAITEQYGHPCYKTLGEFTYQVGNGKPPSEAILGSNYAVNHGDEEASISLSVQGNWTETKTWSSETTTGLTISSKFTLEGVFESGAEFSVSTTVGESSSTSVSRSASSTVTVTVPPRSKKKVSMVGTMKQETMNFQAPLSVQGSFGANFPRKVEDHYFWFLGADNVLNSTTGTLTGKIKNTAVFNVQTEVGAAEPLDAKTPV

SEQ ID NO: 207 - protein, 251 aa, Bacillus sp.
MPIQEKFSFSELSAVGSNPNSIREKFKERFGVLPDGIAVNSETYYDAAKPAITEQYGHPCYKTLGEFTYQIGNGKPPSEAILGSNYAVNHGDEEASISLSVQGNWTETKTWSSQTTTGLTISSKFTLEGVFESGAEFSVSTTVGESSSTSISRSASSTVTVNVPPRSKKKISMVGTMKQETMNFQAPLSVQGSFGANFPRKVEDHYFWFLGADNVLNSTTGTLTGKIKNTAVFDVQTEVGAAEPLDAKTPV

SEQ ID NO: 208 - protein, 252 aa, Bacillus sp.
LMPIQEKFSFSELSAVGSNPNSVREKFKERFGVLPDGIAVNSETYYNAEKPAITEQYGHPCYKTLGEFTYQIGNGQPPSEAILGSNYAVNHGDEEASISLSVQGNWTETKTWSSQTTTGLTISSKFTLEGVFESGAEFSVSTTVGESSSTSISRSASSTVTVNVPPRSKKKISMVGTMKQETMNFQAPLSVQGSFGANFPRKVEDHYFWFLGADNVLNSTTGTLTGKIKNTAVFDVQTEVGAAEPLDAKTPV

SEQ ID NO: 209 - protein, 251 aa, Artificial sequence
  variant of native sequence
MPIQEKFSFSELSAVGSNPNSVREKFKERFGVLPDGIAVNSETYYNAEKPAITEQYGHPCYKTLGEFTYQIGNGQPPSEAILGSNYAVNHGDEEASISLSVQGNWTETKTWSSQTTTGLTISSKFTLEGVFESGAEFSVSTTVGESSSTSISRSASSTVTVNVPPRSKKKISMVGTMKQETMNFQAPLSVQGSFGANFPRKVEDHYFWFLGADNVLNSTTGTLTGKIKNTAVFDVQTEVGAAEPLDAKTPV

SEQ ID NO: 210 - protein, 251 aa, Artificial sequence
  variant of native sequence
MPIQEKFSFSELSAVGSNPNSVREKFKERFGVLPDGIAVNSETYYNAEKPAITEQYGHPCYKTLGEFTYQIGNGQPPSEAILGSNYAVNHGDEEASISLSVQGNWTETKTWSSQTTTGLTISSKFTLEGVFESGAEFSVSTTVGESSTTSISRSASSTVTVNVPPRSKKKISMVGTMKQETMNFQAPLSVQGSFGANFPRKVEDHYFWFLGADNVLNSTTGTLTGKIKNTAVFDVQTEVGAAEPLDAKTPV

SEQ ID NO: 211 - protein, 251 aa, Artificial sequence
  variant of native sequence
MPIQEKFSFSELSAVGSNPNSVREKFKERFGVLPDGIAVNSETYYNAEKPAITEQYGHPCYKTLGEFTYQIGNGQPPSEAILGSNYAVNHGDEEASISLSVQGNWTETKTWSSQTTTGLTISSKFTLEGVFESGAEFSVSTTVGETSSTSISRSASSTVTVNVPPRSKKKISMVGTMKQETMNFQAPLSVQGSFGANFPRKVEDHYFWFLGADNVLNSTTGTLTGKIKNTAVFDVQTEVGAAEPLDAKTPV

SEQ ID NO: 212 - protein, 251 aa, Artificial sequence
  variant of native sequence
MPIQEKFSFSELSAVGSNPNSVREKFKERFGVLPDGIAVNSETYYNAEKPAITEQYGHPCYKTLGEFTYQIGNGQPPSEAILGSNYAVNHGDEEASISLSVQGNWTETKTWSSQTTTGLTISSKFTLEGVFESGAEFSVSTTVGESKSTSISRSASSTVTVNVPPRSKKKISMVGTMKQETMNFQAPLSVQGSFGANFPRKVEDHYFWFLGADNVLNSTTGTLTGKIKNTAVFDVQTEVGAAEPLDAKTPV

SEQ ID NO: 213 - protein, 251 aa, Artificial sequence
  variant of native sequence
MPIQEKFSFSELSAVGSNPNSVREKFKERFGVLPDGIAVNSETYYNAEKPAITEQYGHPCYKTLGEFTYQIGNGQPPSEAILGSNYAVNHGDEEASISLSVQGNWTETKTWSSQTTTGLTISSKFTLEGVFESGAEFSVSTTVGESSSESISRSASSTVTVNVPPRSKKKISMVGTMKQETMNFQAPLSVQGSFGANFPRKVEDHYFWFLGADNVLNSTTGTLTGKIKNTAVFDVQTEVGAAEPLDAKTPV

SEQ ID NO: 214 - protein, 251 aa, Artificial sequence
  variant of native sequence
MPIQEKFSFSELSAVGSNPNSVREKFKERFGVLPDGIAVNSETYYNAEKPAITEQYGHPCYKTLGEFTYQIGNGQPPSEAILGSNYAVNHGDEEASISLSVQGNWTETKTWSSQTTTGLTISSKFTLEGVFESGAEFSVSTTVGESSSTSESRSASSTVTVNVPPRSKKKISMVGTMKQETMNFQAPLSVQGSFGANFPRKVEDHYFWFLGADNVLNSTTGTLTGKIKNTAVFDVQTEVGAAEPLDAKTPV

SEQ ID NO: 215 - protein, 306 aa, Bacillus sp.
VERRLKFMAIFDLDVYLMELAKKHFPPPFNQYISRIDTTSLLKVKNAESYGFEIKNSKPQGTMFMGESVLKNDTNETQTIKSDSFTKTITDSITLSVTNGIKTGIEINVGGKVFGIGVETSMSFEVSTSTTREQTSTEGVAYTVPSQDVVVPAKKIYYVYTALQRSQLEGTIRLRADLFNGFGIYMNIGGKEIPLGSYWIYDFIKENQSLHPLPSGISLNHNDRSVHFEGVAEYLYGTGTKFNVTITDTPSSQGTQEHKPFDAKTGLGTYELRLDGKKLGFDLNDLKEHMDPKDFEKLKEMQNEIV

SEQ ID NO: 216 - protein, 299 aa, Artificial sequence
  variant of native sequence
MAIFDLDVYLMELAKKHFPPPFNQYISRIDTTSLLKVKNAESYGFEIKNSKPQGTMFMGESVLKNDTNETQTIKSDSFTKTITDSITLSVTNGIKTGIEINVGGKVFGIGVETSMSFEVSTSTTREQTSTEGVAYTVPSQDVVVPAKKIYYVYTALQRSQLEGTIRLRADLFNGFGIYMNIGGKEIPLGSYWIYDFIKENQSLHPLPSGISLNHNDRSVHFEGVAEYLYGTGTKFNVTITDTPSSQGTQEHKPFDAKTGLGTYELRLDGKKLGFDLNDLKEHMDPKDFEKLKEMQNEIV

SEQ ID NO: 217 - protein, 331 aa, Bacillus sp.
MVRAYPDFDEMIREAAQKWSEANGLLFQNVSYSDPLTNTDTISLSVKFKDIGSLEECVELEKIRVSQAFTNNTGQQQKETFETITYVEDEYTWENDYHLVLPGQNFLTMPRLPRSAHKDINPGFLVNFFGENQQFHTKMRERRPIRGEVFLEPSSSATIQLQVEKHHISQPYEIELSILGSIIVTAQDRGQEQGTDRYVGLTDLIPFLCPHKNFFSKGRALIFLEQGTFTGILSRAIRAYATQTLHCDGKTLEYEIPLNNPLPESALQPKPMTTNATSCGCSSDRPSVVSTYSHPANPTAYSQQPMTTDSTSCGCSSCMSARSNKTLYTNQ

SEQ ID NO: 218 - protein, 331 aa, Bacillus sp.
MVRVYPDFDEMIREAAQKWSEANGLLFQNVSYSDPLTNTDTFSLNVKFKDIGCPEECVELEKINVSQAFTNNTGQQQKETFETITYVEDEYTWENDYHFVLPGQNFLTMPRLPRSAHKDINPGFLVNFFGENQQFHTKMRERRPIRGEVFLEPSSSATIQLQVEKHHISQPYEIELSILGSIIVTARDRGQEQGTDRYVGLTDLIPFLCPYKNFFSKGRALIFLAQGTFTGILSRAIHAYATQTLHCDGKTLEYEIPLNNTLPESALQPQPMKTNATSCGCSSDRPSVVSTYSPPANPTAYSQQPMTTDSTSCGCSSCMSARSNKTLYTNQ

That which is claimed is:

1. A recombinant polypeptide having pesticidal activity, comprising an amino acid sequence having at least 90% sequence identity to the amino acid sequence-set forth in SEQ ID NO:58, wherein said polypeptide further comprises a heterologous amino acid sequence chemically linked to said polypeptide.

2. A composition comprising the polypeptide of claim 1.

3. A nucleic acid molecule encoding a polypeptide having at least 90% sequence identity to the amino acid sequence set forth in SEQ ID NO:58, wherein said polypeptide has pesticidal activity, and wherein said nucleic acid molecule is operably linked to a heterologous promoter.

4. The nucleic acid molecule of claim 3, wherein said nucleic acid molecule is a synthetic sequence designed for expression in a plant.

5. The nucleic acid molecule of claim 3, wherein said heterologous promoter is capable of directing expression in a plant cell.

6. The nucleic acid molecule of claim 3, wherein said heterologous promoter is capable of directing expression in a bacterial cell.

7. A host cell comprising the nucleic acid molecule of claim 3.

8. The host cell of claim 7, wherein said host cell is a bacterial host cell.

9. A vector comprising a DNA construct comprising a heterologous promoter that drives expression in a plant cell operably linked to a nucleic acid molecule comprising a nucleotide sequence that encodes a polypeptide comprising an amino acid sequence having at least 90% sequence identity to the amino acid sequence set forth in SEQ ID NO: 58, wherein said polypeptide has pesticidal activity.

10. The vector of claim 9, wherein said nucleotide sequence is a synthetic DNA sequence designed for expression in a plant.

11. A host cell comprising the vector of claim 9.

12. A composition comprising the host cell of claim 11.

13. A method for controlling a pest population comprising contacting said pest population with a pesticidal-effective amount of the composition of claim 2.

14. A method for producing a polypeptide with pesticidal activity comprising culturing the host cell of claim 7 under conditions in which the nucleic acid molecule encoding the polypeptide is expressed.

15. A plant having stably incorporated into its genome a DNA construct comprising a nucleotide sequence that encodes a polypeptide comprising an amino acid sequence having at least 90% sequence identity to the amino acid sequence set forth in SEQ ID NO: 58, wherein said polypeptide has pesticidal activity.

16. A transgenic seed of the plant of claim 15, wherein the transgenic seed comprises in its genome the DNA construct.

17. A method for protecting a plant from an insect pest, comprising expressing in a plant or cell thereof a nucleotide sequence that encodes a pesticidal polypeptide, wherein said pesticidal polypeptide has at least 90% sequence identity to the amino acid sequence set forth in SEQ ID NO: 58.

18. The method of claim 17, wherein said pesticidal polypeptide has pesticidal activity against at least one of a lepidopteran pest, a coleopteran pest, or a hemipteran pest.

19. A method for increasing yield in a plant comprising growing in a field a plant or seed thereof having stably incorporated into its genome a DNA construct comprising a promoter that drives expression in a plant operably linked to a nucleotide sequence that encodes a pesticidal polypeptide, wherein said nucleotide sequence comprises:
(a) a nucleotide sequence that encodes a polypeptide comprising the amino acid sequence of SEQ ID NO: 58; or
(b) a nucleotide sequence that encodes a polypeptide comprising an amino acid sequence having at least 90% sequence identity to the amino acid set forth in SEQ ID NO:58.

20. The recombinant polypeptide of claim 1, wherein the polypeptide comprises an amino acid sequence having at least 95% sequence identity to the amino acid sequence set forth in SEQ ID NO: 58.

21. The recombinant polypeptide of claim 1, wherein the polypeptide comprises the amino acid sequence set forth in SEQ ID NO:58.

22. The nucleic acid molecule of claim 3, wherein the nucleic acid molecule encodes a polypeptide comprising at least 95% sequence identity to the amino acid sequence set forth in SEQ ID NO:58, wherein said polypeptide has pesticidal activity.

23. The nucleic acid molecule of claim 3, wherein the nucleic acid molecule encodes a polypeptide comprising the amino acid sequence set forth in SEQ ID NO: 58.

24. The vector of claim 9, wherein the nucleotide sequence encodes a polypeptide comprising an amino acid sequence having at least 95% sequence identity to the amino acid sequence set forth in SEQ ID NO:58.

25. The DNA construct of claim 9, wherein the nucleic acid molecule comprises a nucleotide sequence that encodes a polypeptide comprising the amino acid sequence set forth in SEQ ID NO:58.

26. The plant of claim 15, wherein the DNA construct comprises a nucleotide sequence that encodes a polypeptide comprising an amino acid sequence having at least 95% sequence identity to the amino acid sequence set forth in SEQ ID NO: 58, wherein said polypeptide has pesticidal activity.

27. The plant of claim 15, wherein the DNA construct comprises a nucleotide sequence that encodes a polypeptide comprising the amino acid sequence of SEQ ID NO:58.

28. The method of claim 17, wherein said nucleotide sequence encodes a polypeptide comprising an amino acid sequence having at least 95% sequence identity to the amino acid sequence set forth in SEQ ID NO: 58.

29. The method of claim 17, wherein said nucleotide sequence encodes a polypeptide comprising the amino acid sequence of SEQ ID NO:58.

* * * * *